United States Patent 10,407,724 (METHODS AND COMPOSITIONS FOR SCREENING AND TREATING DEVELOPMENTAL DISORDERS) - sequence listing, part 26

SEQ ID NO: 620 - DNA, 1027569 bp, Homo sapiens
  misc_feature (229039)..(269038): n is a, c, g, or t
aaggccaggccagcattataatcatgcatgagaaaaatccaagacaagtatttccaatgcctgcagccaactggctctgggcttgctctgctctgcagaagaggtggtggaggcacgttggaggacacaggcccagggtcagaggctctggagctcagtccccacctatacaagagtcatcattctagtgcctcagctgaggctcactgtccgtgtctgttagcatggagctcagagaatagacctgccccggtgcagagtaaactattagatgatgagaaagaaaaagaaacattttatctgaggaatgcgagtccctttaaatgatcaggcccagagatgcattaaaatatgacagcagtcgtgtctcactccacttgagctaaacaatgacctcttgaagccacttgctatgtgggttctaaactgactgacgccaagtagccaaaaaatgccattcaccttatagttcaacaatgtatagccaatcactgaccaatgttatttctgtaaaccaacgagaattcctgaggaacaacttctgtaattgcccccttcctgagtcgtcattttttctttaaaacttgagcctctcatttgttttccaaagcacttcccagtgtgcagtgtgcacttccccattctgcggtgctcaaccttggcccaaataaactccctgtttattaactttgcctcggtttctttctttaggtcaacaatgtggactgcacttaacctcaaatccaacgcaacgtcctggccctgggatgttcacagtgaccaccatgccactgcctgggccgccctgtttgtccccaaccctctcttcaccatgatcagccttcgtgtatggtgtacccatgacataactaactccatcttagaaaaagcctccatttcttttcatagagcactctgccaacaaggagaagatattttgttgaataaataaataaataaataaaggctgcatccaaccagataaggacacgcgcacactcttccactattggttctcaccagagggccctgtgaccatacaagattaggcctgaacagctccaaatggccgtcttaactgccactttattgcagtcactcgtgatgagagcttgacatctgccgccagaagctctgctaccttcaagattttcttgtaagactgatgaatccttcggtccagactgggactccttttgtcttcttggcttcccctggactggttcattaaccctttctcctatctctttttcttcttgatgttaaatgttactttgtttgctgtggaatgtttaccttacaccatttataggttaggtatactattatgtatggtttgcaatactgactgacttatggagtggcatcagcctgtgtgcccgcagctctggctgcaaagtaatgggaaatactacggaaaattgcctccttaggagctccatgtagctcatggcttttgtgattgaatcacaatcaataaaagcctgacactgtggaaaaacacaaacatgcgtggacctagttatctctaaccttgcactactcatgacacttcggctctggggcttgtggtgcaggggttcacatgctgtccactctgtcagatgaagcccacttccaggtacttccaacggcatgtcaacccggatcttctgtcctcccagagggacatctgaagtcacttcagctgttcctaatgtgacatatttttagtccattcatcatcctagtcacttgcttcctatttttccttttatatccctttagttcttaatgtagtgattttctttaggaaaacaacaacaacaaacctgcatgtcttagctgagtcctggggaaaaagaaaagggcacccgtgtctgtccagattaaagtccgtgcatgtttgtgtctttccacaatgtcaggcttttattgattgtgattcaatcacaaaagtaaagggcctcagaacagggactggcttgggggtggggggattgcgctcaggcctcaggagacagacacaagagtacccccaccaggcttaactctgctcacagctaagaaggtcttctgttgctaggaaggaagaccctttccttctaaccaagcacacaggccagaggtttgctcacccaagcacttcggatttgtaaccagtgagggcccaagacagactgtggcagctaagcaggaggtgggaggtggagtcaatgagctcccgcagagggagaccccactctgctcttgtttctcgtgtgtattcacaggccctgcctgcattgccaggcctcagcagagagacaagaatgacattcccgtggcggcacccagggagtgctgattccacttgaagatttcttgctaattgaacagttacttacaccttagctaagtcttgaaataatttctcaaaaataagctgcgaaattcttcattggttgaccctagcattggagaaaattgttctgctcaagcagcaaagaatgagttttcttaactggggctccaggggatgtgccaatctacccagtagaatccaaaagaagtaagaatttcacacagagatgctctgccctgaaatggatgctacacagggcctcagcgatcagatttccgggggacagacagacaaatccggccataaaaggtaggcatattgttagcaaaatggagtccgaaaaacaacagacctgggcccacgcatccaagtgtctgggtcacaaaccatctgaagggtccaattctccccaatactgctgtcagcaaagactcggagactgcaatgggggggaacacagtcaggtgtgcagcgtggcctgccctcacaggtggctgtcacggattcttcttttcctaaatttccacctaggggctgaatcatgtgcgtccattggcacaggttggacttggcccgtggtctcccagggcatggtgccagccacatgctctgccctgccccctgtcctgtcaggtttgaggattttacaaataaataaaaggagcaatattatagcagcaaatcaagagtaaagatcaggtggattggaggtatatcagaaagaactgtgatcagtttagctgttcttggcaacattgatgggccactaccagtcactgcctttgaacaataacatgaaaggaaaagtcgcatcggtgaaaacagtggaactgaataataacgaggaaaacaaacatctacatttacccatgtttttcctttaagaaagaaaagttacatttgttctttatatgcttaaatgtttaatttccattagaaggagtaaaaccatcaatttcaggtacagggtgacattagagaaggccaactattttttaaaattatgtctactttaaattttgtattgcctggtgctattgtgtttttttaaattgtggtaaaacaataacataacatttaccatctgaaccatttgaaggcacagttcagtggtgttaagtgtatgcacatgtatatggttgtgcagtacatttttaggacttacccatcctacaaaactgaagctctgtgcccattacacaaccctccgttcctcctccccacagcccctggcaaccaccccactctcctttcagtgtctatgaatgtgactactctagggacctcgcataagtagaattataaaggatgtgtctttttgtgactggcttatctcacaaagcataatgtcttcaaggttcatcgaatgctgttttaaagtctgtatgttatgcaccatgaaataaccaattaccatcatgttgagtgcttgtacccagaaggctcaccatattccttcccagatttcaaaatagagatgatgatgattcttgtatgacatcaccttctacggctcccagcattcgggggtttgtcatactacctgttctactcctgcaaattaacttcagaacaccattcttttttccatcaatttaagagctgcatttgctaacccaccctcgggccatgtaggaacaagcatcgactttcacatctgagcaattctttgtaagttccatgtcatttgcatgttcagaaaagcaatatttcgccatggtacattgacatacctatcagcactgttatcacaatccagaggcgcctgtgttttttcattaacaacagcctgtgttttttcattaacaacacttaacgctgcttcactagttgttttccaaatgttctgtaagaaaaaataataaaataatgtgagagagctgcttatgaaaacccagtacatttgggaaagtaatattacttcattaacaaaatagcagtggacccctgctgtgcgcccagcactgtgctgggcaccagagaagcaacagcgaggaaagcagacagcttcatcctcccagggctcctgttctgccagaggaagccagaaagcaaacatgtagccataacagcatctgctgggggtcgtgctgcggaagaatagagctgcaggagggattcgtgcggggtcgggacggggtgggggtggggggggggggcgcggtgcttttttatacacagggtcagagaaggccgctgtgtgtgacgacatctaagcagagctggaagaggaggaatgcagagctatgccgaaggtggaggcacacctgcttcactgcaggagcagcagaagtctcgtggggctgcagccacaagtgggaaccaagagagcacaggaggtgacctcagagttacgggaggccaagtggggtcagactcaggaagtggagtttcattctgaatgagatggagggttctgagcacaagagtggcacgctccaatgcacagaagcaacagtgtggttgcggtactgaagagagcctggcaggcaggagtggcagcaggggatccactcagagggctatgaggatggcaggtcttgattgtggagtgaaggcagagggtgaacacctctgaggctatggggtggccgggctggctgctggactggaagtgagatggagcccaagagagaactcagagacaatgccactgggcttgctcggcctgtgcacactgagagcttaggtggggtgggggcattggagggcaggtgaggggtgctgggagcccatcttggtcatgaggcctctgttgaccttgcattgacctgtgcagctctccttgtgacaaaatctcaatcctggtggcaccaggaaagcagggaggtgcccacggcacaggaggaggggggacacttttggcctacgggaagctggccaccttgtttcctacacaggacgcctgtccagagacaacgccccactgtggacatgattacaaaaagcagccaccatccctcagactgagggcccagggcctcactctggctcttgagagagctgttaccagaagtagttccagccagttaagaagttagtataggttaaccaacggcccagcccctccctgggatgtgcgctccctgtgctgtgggccttttacagatttgtaactacaggacatcaggtgcttcatctttcaggagaacaacacaggaaggtgtcaagaaggccagagtgggagctgaaagatgccagctcgtgcctgagtgcatacgcctggcacctgcccctcttctgtgacgagaacagggaacccctctgtggcctcccagagcaggacctgggtagatcctggcagtttcctgaggatgtgaaacccaggggctgagacagctgcatgtacctacaacccctaaaaggcatggtgctagtgagcagcatgggagacacagggctttgcaagacactatcctataactatgcccaatcagcaaactgcccagcacgtccaggagctggtgtatggccctgtgtgaccttcgcctgagcccactggggctgtagagagcagagcggccagaatgcagcttggaaatgggtctcccagtcaaccaaaaccagagagccccctgattgcacatttcaccaggaccaagccctttgggacatgatggtcaaatcctaaaggcatcgatctatgcccaaagctgaggtcccaggtggctgaaccttggagtcacctgggtggggtggggttgaagcaccatcaccctgagccacgccacagcatgtctgttagaatcttcagaggcagggcttgtgcatggttttgtttggtttctttgacttttaagctccctaggtgattctgcatagcagatctgcaccaagtgttcaagaagcatgaggtctgtttgcccccttgtgtttggaggtgagggcactaaaagcctaaggaagtcactgtatgtggctatttacattgtgtaatgtgagaaacgcaggtaatatcacctcccctctaaaacacctctccccaacctcctgttctcagaaccatcagacgctcatcttactaaatatccttccttgggaacctaaaaatgcctccttgaactttcgctgacaaaagtgatggcagagcagagaaaagctcccaaacacaaacactgtgggttgagatcaaattcatttcaatataaactcagatggatgtgctacggagggggtggtttaataacgctgctctgcatgaggaatactgaaaaatgaactgcaggagagtctttgccaaggacagcagaggttctgggagcttcaaagagaactggcttctttaaatttgaactagaaacgcacaactctgggctgtctgtgcatgtccctttggaaccaatgcttattctgggtgaaaagcatgtctcactcagaagttttcactcttctctcggaccccacccacagatgtgagagtcactcctctcacgcttctcctccatctccagggcattgcccaggccttcagacccaagccctgttagctactctgataaacagatgcaagggaattcacaaacatccaggtagcccagtcttaattaataggggtcttcaacgagctccccacactgcgcaagttaagcagggtttcagtgctttggctgctggaagccttgtctgtgctggagccatctcggggcagctcccactccccacctgggggacagcacccactccccaccccggggatagcccccactccccgcttgaggggcagcccccactccccacctgagggctaccctcctacttcccacctgggaggcagcccctactccccacctgcagggcagcccccactccccacctgagggctacccctcactccccatctgagggctatcccctactcctctgggctgggctagccctgcctgcacttcttatatgtggaactatgctctggagctgaattaaggctttataagtcacacttgcttcattggcacaaacacacatgataggaaaacaatccctgatgaattcctgatgaaacatggaggtgctttttagctgtactgtacatgtactgtattcaggaagaaaagcctaatttccccagatccaggaataccttctgcctggaagctgatgaggatgggctctgtgattcccggtcttctgcctttccattcagagcacaccaaggacagccacacttcccatcactcataagaagcacatgattagcatagacctctagagaaaaaaaaaaaagcaaacattctgaagactgcaatgtgctgggaaggtgagaacataaagctggagaagccctaagttatacataaggtcaaagccacctgggcctaacaacgggctgatcatgaagatgcgtgtccttgggctgccgtgtcctgctgtgtgtgttttctttctatttccttgcttaaacaatgtcttaggtgtagcccacactaagcaatatgaggaaacgcacaaccaccagccacgctgataatgaatgcctgttccagaaacacccagtggtctggtcataaaataatgagggtcaaaggtcctgctcaggggtgtgtagtagagggggcaacaccacagtcggaaggagtggttggggagctgttggacaaacaggaagaccattaaagacactccaaagtttataagcaggatgttcccacccaggcaatctggccctgatggtagcacggacctggctgacgttcactcctcccatctctgagggctgaaggccgggcagtgagcggagccagtgtccacccggctgggaggctgagggccctgccacatcccatgtctgtgagagcatctggaataggatctgcgcacagctgacaactgttgccagcgatgacaggtccttgagtgtttgtgatgccattctctctactcatgcagatgtttgaaaatgtccataataaaagttaaaagaaaatatttctgctagacctggccctgcacagagccactctcagcaagaagccaggcgactgccttgggtgcaagagctgctttccctgaagcccccacccctctcatccccaggtaggaggggaaggaagtgggggtggcgggtgaagaggggactggagcaccctgctgcttttctgtcagacccgagtccctgtaaggaaacctgtttctgcctgggctctcttaaccccagtctgttattctggccagctttgctcaggctaaaaggaacccaaaggcctgcaggccgccgagagcagcaggttctccaggagctccaggccagggctgggccatcctcacaggggatgtggcttccaatccctgcaccccagcagtggtgctggcagtcagcttgcccctagcctcccaggacactctcaagtttagcctaggacaatatcaaatccagttttaacattgtgagtcaaagtcactatttactgtcaagagtccagtgtattaatatcttgtgataacaaaagctgaggaaaaatcaaaggccgtgttcctggcctaatatgtgacgtgctacaaatgccatcgagtgccattgagcacccatgcaggctggatgcaccaactgaggtatgaagtaatttcctgaactggacacatccgagaggaagaaatatttagaaaatgtttcggaataagctagaatagtcaagtgactcatatttctctgaaaccaattagtcatcaaagtcactgtgctcaaattatctggaaaaaaaagtggatatacccctgaacagaaagaaataaataaaaaatcataaaaagtacataaaattgcaaaattgaataaagtatgtcacaaaaggagaaataaactaagtgagtgaaactaatcctgaaattggcttaattgtcccacagaagtgatatttataggttttttgaataaacatggaaactgactctcctagtcttaaaacctgaaacttaacatccatctcatctgagttcttccctcaggaaaccaacccaggaaagggacccaccagatccctgcatccagccaggcccctcattcctcagattgcttcctcacccctctctaattttgttttctcgtcttccctgctatataaacccccaagttttagtcagatggggagatatatttgagactttatctcccttctcctcatctgcagcacctgataaagctttcttccctggcaatcctcgcagtcttcatgatgattatgctctgtacgtaagcagcagcagcaggatgtcaggcaaacccctggcatttaggtaacaattccacatgatcttaacataagaattgcaaaagaattggcgttgcattgtttcaacattgatgccaggcacacacccgcctcctgccccgcgcccccgcccccccactccatttaaatccgtctctttagaaattaaaaaaatttttttaaatttaattttaaaaatccgtttctcaggtctaccaaatgtgtagcctaagttgaaaactcaaaaattccttctacttaaaggaatcctggcaattacgtttcaggcaacactttagaattttcattttaaaaattaaaaacagagatactctctgtgttaaggacgaggaggaaaaccccacacctgtggccatgcagacacctcctgtaacctaagtattcccttcattgggctctgggaggccccacttacagtcttggttgttctcgaagtgtggcccccagatctcagcctcaccccagacctcctaaagcagaaagtcaggggtggggcccagtgaaggagttaaaaatataccatcctggccaggcgccgtggctcatgcctgtaatcccagcactttggaaggccgaggtgggcagatcacgaggtcaggagatggagaccatcctggctaacacggtgaaaccctgtctctaccaaaaatacaaaaaattagctgggcgtggtggcggacgcctgtagtcccagctactcaggaggctgaggcaggagaatggcgtgaacccaggaggcagagcttgcagtgagccaagatcatgccactgcactccagcctgggtgacagagtgagactccgtctcaaaaaaaaaaaaaaaaaaatatatatatatatatatatatatatatatatatgtgtgtgtaccatcctggcatgtggactatttaagttagaggcacttgcaaaacagcaggtttaagatcactctgaccttccttctgtttcttaaaagcagaaaatgaaattcccatgtggaagatgtcctgtttataccagggaaataaagcaacattcttatcatggtggccatgcctccttccccaaggccttaccgacccacaatccacctccaggagggctacagctgcacagatgaagaccccagctcttgtcagtgctcacagacagctcaccaccaaaggaaaggcagcaggcagcctggagacacctaagggaaagaaaataaccagaggaaaattaaattaagtacaatcgtttaatcacagacatcctgtgaccactcttccatccatatccatatttctgccacaaaagtattaagtacaaaattggctgccatatgaacaaaaagactcgcatctatggttcttttcacttcatatttcccaaactcagggtctgttttagaagattaactgaaatatagttcccatctgactactaaaacagcctccgaacagatccatctctcttcctgctgcctccagggcttcctgcccagatgcacagagctgaccttccagggcaaggtctggcagcttccagggctcctcttcctcctcctctcttcctgcctcatcatccccattcctgctgctcactcacagccctaagagcacattcttccagcccatggggatctggcatgctgcagaaaagaacagcatggaacccatgaccctggggagagatgccagcgcagacacagagtaggcactgcatggcatcctccctgtttatttccacaacagacttgagaggttccgtgcagttactttttcagatgctggtatcattttggtatttgtccctgtgcaaatctcatgttgaattgtaatccccagtgctagaggtgaggcctggtgggaggtgtttggatcacgggggcagatctctcatggcttggtgctgtctttgtgagttctccgagatctggtcatttaaaagtgtgtggtatctcctcccctcctcttgctcctgctgtcgccatgtgatgcacctgctcccccttcaccttccaccatgattgtaagcttcctgaggcctccccagtagcagacgccagcattatgcttcctgtactggctgcagaaccgtgagccaattaaacttcctttctcagtctcaggtatttctttatagcaatgcaagaatagcctaatgcagatgggatcatgaaggcccagcaaaacaaattaactcagcgaagctcacaccatcagtgagaggcagagccaacgtttaaacctggttctcagcacacccaaagccgatgccaattctatggcaccttccttcaaagctctctacaggtgtgcctccagagctcaagctgcagctgaagtcagccccaaagctctgccccttggcacagctggtgactttccctctggactccctaggccttgacagctgtctgctgctctcatgtttgtcagcagagatcatcgtgggtcatcatctggtccctggtcattccctttcagcctgtagctccttgggtcctgaggtatctgtgtctggcaccaatcgacttgagaaagatcaagtgcagcgagtgaaatagtcctgaactaaggtgcgggtttcctgggttctggtcttgattcagccagaaatggatggtgtgatttgggtttctcctccatgcccattcccagcgacagggcaatgggaaccgttgccaagttcccagctccatataggctgctgtgctaaggagaagggcaggctctacatccacttcttctagacacaggcagtcaccttgcctctctgtgtcagtctccttctctgtttgagaggaacgacacagacctacttcacggggctgctgccaggactgtcattctagaaagggccgccctgtattagctaaatgcttggtaaccagctgctaaaggtgttcgcctttgttctttcccctgaaaaatgcattcagctctttagaattctcttttttacctgtcttggatgtctataaagtctagaggatatctactttatcttaagcaaggtttctacaaagataaaactggatagtttcacccaatttttacaagcctggttcttgatgcccaagaagccgccaccagagggcagacgaggacaatatttatagttgaggaaagtgtgcagggaggtgaaaagctgttattttgaagatgaagatggtcactaggtcaaaggcctcaaactgttgaataattccaaggatttccttgcctactctcaactatgcttgtcttccaaaggccagagaaatgaaaaaataaaaaataacaataatagaaaaggggacaactttggaatcatacagaccagaccagatcagacttagaggatttctgcaatgatctagcgggcaaataaaattaaggaaaggacgaacctaacctctgtccaccacgtgcgccccacagtccacagctgtgagactgcccaccactctgggcccacacaaggttagatagccctggcacccaccaagttccgagaccctcccagacacccccacaacaggataacttccaagtgctacacacagaaaacaccagccctggttcctgggacatagttggcccttgagaagtaattttctgtctcagaaggtgagaaacacatccccaacaggtgtgtcctccactcacagaggcgccaaggatagtgctgcaaagctaattttccttgagatttcagaggtcttttcaaataaaaaaaatggaagggggagataatttaaatacaagggaggctctttttcctggtgttgtgaggaggcaggtccccaggccctggcacagaatcagcaccattttcacagaggtacctggcttcctcttagttaactgtgactgtcggggaacaggatgatactgatggctcaaacacagtctctgaggcatcatgtgcctcaagggaactagtcgagccatttgtttgaattacatgacagatctcttagaatcccttaagagtgagtgtttttcggggcctgtcaggggctggggggcaaggggagggagagcattaggacaaatacctaccacacaaacacacaccacacactcacaccacaccacactcacaccacacaaacacaccacacagcatcacacacaatatacacacaccacacagcacatacccacccaccacacacacatcgcacacaccacacaccacgcaccacacaaacacaccatacacacaaacaccacacacacaccaacacattacacacacatcacacagcacacaccatgtatcacacacacaccataccccactcataccataccacacatacaccacacactacacacagaccacacaccacaccacccacacacatgtcctataccacacacacacacacagacactacaggcctaactccatgaaatgagggctacaggagagtcaagaaacctcttctgtttctatgaacaagatcagtcactgtcttgctttaggtgactcaggaaaccccaaaaggctatgacttcagaaatggggcctcgacaccaattacaatggctagtgcgtgcatgaactagttggtctgcaagtacaagatgtataaatatacaggggaaaaaacatcaagtcagcgacttccgctcctcagcttttctttcctttctaagggcaaaggggtaattccttgcaattccctgactgataagagtgaaggtcaaattgggccaacatcaaggctctgggagtctgcaggagcatgggcatttggaataaaagaaacatgaggtaaccagaaaaaataagggaaaaaattgtagccaaaatcagacaatgcttggcagcagtgagtgacataaggcaaagaaatttccaagcatgaatgtgaccaaccccgtcaacacgtgcagcctcattttctcatcctggtttgctttgggtttctttgataaaatgatggtgatggcacaaagacagtaagctaacaaaggcagaaatgctgacagcaagcattcatcaaggatactgatttttataacgaccctctggagtttacagatgtgacaacaggggtactcagattttcaggatgagaaatctgggggtgaggaggtaaagtgacctgcagtggcggggtaccccactgggcaagatctgcaggcacaggctcccatcatgccaggccaggggacagcggtgacccacctgggtccttaccacatcccacaggcaggtcaccttgctggcctcacgcccaggaaagggggcatggaggtttgcaccatgtcacactgccatgagacagtcaacagcagagcacacaggctgcccagcctcaacaacacatgggtgctggcgcgcacagagcatggggaagagggtttagaaataagacccatggaggctgggtgcggtggcttatgcctgtaatcccagtactttgggaggccaaggcgggcagatcacaaggtcaggagatcgagaccatcctggctaacacagtgaaaccccgtctctactaaaaatacaaaaaattagtcgggcgtggtggtgggcgcctgtggtcccagctacttgggaggctgaggcaggataaatggcatgaacccaggaggcagagcttgcagtgagccaagatcgcacctctgcactcgagcctgggcaacagagagagactccgtctcaaaaaaaaagaaataagacccctgggccaagaccccatgatctcttcctgtgccaggtttctcctggtctccatgcaagggacctagcagacaagcagatagcttaactttgtctactaccaggcagcagaaagtcctcgaacttggaaggtatcctgcatttgcaggaagagcaatcagcacttctcatggctgaaggcatccgcttggaggagtcttctcaaaagccttcaggaaaaaactccattctcaacaccaactccaacctctgaactgaccccgccggccaaatgcaccctcctggtacagggcctccactcgtgccagagtgagcccacatcctagaggtgatgacttttgaaagaaaatttctgaatgcatactttaaaatcaagcttaccaaaccctctgagaacagtgataactcacctttcctggtcatcagaaatgttctgggctgcctcctcggccatgtcctgtgcaagctggtcacaagtatgacagtcagcagaccagcttcttcctacatcctctggaagacaaagaaatagagcttaatgcttccagcttctgtacttgtgacctcttatcaggacacacatcaaacacagagggaaaaatccaaactccagtaacattttcccaagcagaaacagcttttgttttcctaacactgtcagacaaattccttcctaagaagtgtgcttttgacagacgtggtggctcatgtctgtaatcccagcaatttgggaggccaaggtgggtggatcacttgaggccagaagtttgagaccagcctggccaatatggtgaaaccccgtctctactaaaaatacaaaaatagccaagtgtggtggcacacatctgtaatcccagttacccaggaggctcaggcgagagaattgcttgaacctaggaggtggaggttgcagtgagacgagattgcaccactgtgcaatagagtgagactctgcctcaaaaacaaaatgaaacaaaacaaaacaaaacaaaagtgtgttttaggtagggatctttgtggctgcctgaaacagatcactactcaagggagagactgtacatggaagctgagagaagtctgagaataaaaagctgtaactgttggctgggcgcggtggctcacgcctataatcccaacactttgggaggtcgaggtgggcggatcacgaggtcaggagctcgagaccagcctggccagcatagtgaaaccccgtctctactaaaaatacaaaaattagccaggcatggtggcacgcacctgtagtcccagctactcgggaggctgaggcaggagaattgctcgaaaccgagaggcggaggttgcagtgagccgagatcgtgccaccacactccagcctgggcaacagagcgaggctctgtctcaaaaaaaaaaaaaaaaaaaaaaagctgtaactgtccacaactgcactggggaacaggataccttccacaagagcagaagagcattcctaaggaaggctggcaaggcacacactaggcgcactctgtcttacggcagaacctaggaatgatctggttccgaacctcctgcacctctccttgtttgcaactggcgggtcagactgagttctctccattacgaaacattttctcttatatttttaaagcacttgttagttgtcttagttctttataccaacatttaaaccttcagagattttagaaaacttaatgttttactcagaacactagatattttttctctccactctgaagagagtgataccaagaagagtgggaacgttttcaggcacaagctctttctcagatgggaacacagaccccttgaacaatgatgaaccaagctacgggtgtccggccttggatcctgtgttttctggaactttgctgccaatgaggtgagtaaccagagccctgtggtgggttaaggggcctgctgttgacctaacacacctgtctcctggggcctgctgccacctctgctcttctcacactgccttgtcagtgcctctggctttgtccccactgtgcttgttgtgagtaaatctcagatttgggggaaatgcatactttccaatttcattagcaatacactttcaaatgcgcctgtgaccaagaaaaggataaactgcaaactgcagtttgtaaacgaacaaaatcccttctttctgaagcccctgtgatttgctctgacaccttcctgtcaaatctaaacagagtccactgggtaaagacacctgtgcaaccctgcctgctgggctggcatccatacccacacgcacacctggatgctctgaccttgctgctgcctgttccttccttgtggggctggacatcctgagaacagggcctacatttaaagtttgtgatgtttttgaagccagcagtgctaaccaaagatgccaggaaatgaggaggagcaaagaaagtgacataattgagggaagaaatatgcctgcactgccctacgtgggaggcactctcatagccactctcatagccactctcagctactggagcttaagttacttacaattaaatagaattaagaattagctggagaaaccccgtctctactaaaaatacaaaaaaattagccaggtgtggtgatgcacgcctgtaatcccagctatccaggaggctgaggcaggagaatcgcttgaaccggggaggcagaggttgtggtgagccaacttcgtgccattgcactccagcctgggcaatgagcgaaactcttgtctcaaaaaaaaaaaaagaattagctttagcttctccatcattagccatatttcaagggctcagtagccaagatacaaactatacaatgtttccatcattgcagaacaccctcggggccagcgctgggctgggcagcctcgcctttttccgggcagtgcggccagcattgtttcctcagagcagctgcatccagacaagggaggggttcccagttcatctacattcttgggccatactcctccacctggggtttgccgagcactgcactggtacaacagggagcacaacacagaaccaaactcactgcttccctcccgaggacggaggggtgtgctgcttaaggtgagacgtggatgcagccaagcaaactggaaaacgtcgagttttgaaaactgctttaagtaaaaatattctgaataaaattaggtaaatggcttccaaatatggcccattttaagaaatcactatctaagctcctcatttagaaacaaagactcgatcaggattttgactctccttatgaccttgctgaaaggaggaaaaaacacaagaaaaatcatttctttgcatgaaatcaatgtgcaaggacggaaccccctggctggaagagatcctgggaggtctttccctttgtcttcattgttttaaacaaaagccacctccttagaatttgtttttaagccacattctgtatttcagatttaatacttagtttctaaaactgcttcttaggtaatagttcacttagtcaacccctgccttactccacagacttaaggtgtttagtatgcacatagttcagaatgaatacctgaaagtaggtagcactgcctgaagactttcagtagtcaaagtagaaaagcaaacacaggtgtttacacagttcacagtgtaaaaaggcacagagctgcagtttacacagcacagggttcctcctcagatggaaacttcagcaattgttctcacatgggttttcatacttgaagatgtaatagatggcatttaatgatactaagtttcagatttggggaaatattacatttgcaactcaggcaagtgtatacataaaatatacaaggaaaaataacactagaatgatggttatcatgagcaaccaacttcgtttctcaggtttcaatgcaagcccaggttctgatcattatcatctcatcttctgcctgcttcagtttctcacctccaaatggagcttcccgggaaagcacctggcccaccagcatcacttgaccttcttctctttggatgagcagtagcacatgctgacatgtcccttcctagcaagactgccagtcactgtcatttccattctgttccttgaggcagcttgtggacctctactcatttacctttagatattctacatctttttttaattaacaccctatccccactcccagcccacgctctgggtcccatcacactcacggagacaaacacagtgcttgggcaaatttttgtaattagttgtggtgaaaagaaagaaaaattgataagatcttggtagaatgtcaaacttaccatcctttgagctggttcccagagcaggctgcaccaaggagagcaggggcaaggctgcgatcagccccctccaccccatttgcaagcaggctgctccaatggggctgctgatcagcattcaaatcaggggtggctttggggaagtgagcacaggtagaaagcccataaatggaacccgaagcaacagggactggccttgctccgccccatgggctggagcagtgagccttccctgcctccattagcatcttgggacaagcagccaatcataagcaccccctgagaaagaaatctcatgcccagaagagctctggggccttagcctcccttcaccccaatatgcttctgggccgttttctctgagataagtatgtcctaagtgatgttaatttgcagggaaatatgtgtcaatcatctgtgaggctcaatagtagctccactaaagaaaaacaacatagttattgaagtatcatgattttgtgaaaaatagctgagtgccctgtaatttgcagtggaagggcatcatggtacacttttaaagccattgtcaagttagaaaagacaaatttgctatacctgggactaaaagtaggtactctgtcttatataaaatcctcaataatttgaattataaatggcacctctctcttctgtagttttccgtgctttccattggcttcaaaataaaattaaatatcatggcttgatatttaaataccttgataggctgcccccaaatgccttgggtcctttggccacttggagtgtaggggaacataaccataccctaactgttctctctgcaaagtcacatgcagcaattccactgaaggaatgcgatgatcacagtaggaatcatctttcagcactacagtttggtgatcactttgatttttctgtctcaaaagtacattacaaatagggaattgccataaccacctctgcatttatcttgttccaatgcaattgttaagaaaagcataacacatgtattacatggggtaatgttttaggccctcaagcacttattttgagtagtatacaattatccgtatcatctcagcttcctcaccctcacctgcccaccttgtttccatcaaggtgtcctttcgtctggagtggtttctccacactgattatttgatatagacaactggtatttcatgaagtatgaatagaatcctcttaggaaaggactgctacttatgtgagcccagatcgtatgatggtacatgccaaggcagacccaggacaagtcccatggtccctctcagcttccccatggagctgagttggagcaccactgtttctcttggttatttcagacctgtccagtgtgaagggaggcccacctgtcatttgggacaggttaagccaccaaacatctaagaatcacactgggcatttctttctagatttaagactgcatgctccaaaaactggtaaagccccaggtaggagctgctgtgggaaggccaaatttgaactaggtgaagtgttaatgaggaagtccagcatcccatcaagcacttccctcacgagggccccttatgtgctctgcctccttggcagggtttatttgcaaacagtgaaagaagtgaacagagaaaagacaaaaacacaaggtagatgccctccactctgttctggttctcacttctgtctggtcatgtttttcttcccctgtaaggggaggatcctcccccagaaggcttcactagaattttctctcagcaaggaagataaccaaaaagataattttaaattgaaactagtatggtaaaaagtggttagtgtatatatgtagcctcctttaaatttttaaatagcttgaggttagaaacacagggctgtctggtcacaaggtttgagccctaaggtcactggatgatgtcatggtgcgctaagacacgccaaccaaacctctatgagcctcggaagagccatggaagtcacccagtctgcactgtgtgctgccgtgaactggcagcctctggttagcagcgtattttcactgagaaaaaagccaatttttgcttgttttgtttggtaaggcttatgttatggtttaagtgtgtcccctaaattcataagttagaagcttggtcctctgcagtggtgttgggaggcagagcctgatgagaagtgatgaagtcacaaggactctgctctcatgatggcttaatgctgttaccaggagaatgagttgttatcaaagatggtctgcccctcttgcctcctttctgtctcctgcacccacttctgccttgtgcccttctgccaggggacaatacagcaaggaggccttcaccagatgcatccccttaccttactttggacaccccagcccctaaaactgtaattactcttttctttataaatgactcagtctgtgggaatcagctatagccacacaacacagactaagaccgcttataaatgctcacattttacgcttcccaatttagaaacctgccaatgagtaatgctattttctcttattccaaccaccacaggtggtcagcatgtttagtcactgttagagaaactgtctcaagaggctgaatgacttgccccagactaggacgctggaaagagccaaaatccattcccagatcttagggtgtggaattcagcatctttccaagctacatatgctggttatggttgtaagattggttcatttggtgctacaggcgaataggaactagattccaggaaggcggctacattttctcgtgctacccacagggtcatcttccttactgtccagtgatttgtgaagtcctgtgcgtggctggtctctcccaggatcttttagcctacaacttaataactggtcactctgccctcactgcaaagactgttacagacactgattgatcctcatccatgttgggcccatggtaaaaagagatgattctgcaatgtggtgccaccttattgatcgagactccagtattctaaacctggcataacatcaaaatgacaaataaaaagtttaattttctatttatgaaaataaggatgtgctgtgaaaagagtctgaagtccaatgttcgggaaactgtaattgccgagtgaatgtgtaaggcactcaagtaacaaatatttattatttagtcccttaaaaataatttactttattacaaagatagtaatacaatttctagaaaatacatgcatgtacaaagattgaaataaaaaaaacactcataaatatccagatttaaatgtcagcatataccttcctgatctttttctatcatactgtatctatcaacatctaacctgcttttttaactataagtcatacattttgccatatcagtacacttttttctgtaacattatttttagagcatatcaaaccatagtttatttaaccaatccccaattaattcataattagaatatttcgtgtttttccagtataacagttctataatctttgattataacctttgtgtaaattcctataagtattgagtcaaaggagacacacatcttttcaggcattacatataaaataaatactaaactagactccaggaaagtggtatcaattcacattcccaatagcactgtcccaatggggctaatttatctcctttttaatctcagcgtatttccagttataacataccatttttacctcttgattcaacaattgtacttagaagaagctctaaaaatccaaaactgaagcttccttttagaccctccctattacaatccgtatgaaagtacagaattcgagagtgacatcagccaaacggagaagtgaagcttactggcttctctccctaccacataatttcaactagcaaatacccagtggcaagattattgccctgaatatcccagaaattgggagtgaagctgtgacaactcactggaccacagagccaagaaaaaccatgaacagagggtaaagagaatggttctgtttgatcataacacctctcccgcaagcccacatagcaccgcacttggagaatttctctggaatcagtttctacagtgggaaaagagagcgggaggtgggcattcaccttccgcaccattctgagactcttcacaggggcacactatggtcctttccccctggaagcactgcaggtgccagcagggttagcctgctaggtgtaaattagaaacaaagaatgggggtggggctcacagcagtcaacaaacaaatcacagagtggactgcagggaacctgggcttagggcaccatttggcactacacgggctgtagcgttcacgggcttaaagaccaaaaaagacagtatgcttacaatttctggacagacctactatacaaggacaatcacagacaaagccagattgcaaagactgtttataaatacctacatattcaatgcacagatatcaatgtataactacaaagatgaagaacagtcagggaaacatgatgtcaccaaacagacaaagtgccagtgactgactctaaagaggcagagatatatgacattcctgagataattcaaaatagctgtctaaaggtataaaactccctggtaaaaataactcaggaactgataaccaaatgatgatgatgatgatgatcaacccagaggactggttgaattcgttgctcaaaccagagaaaaacactgtcctactaaatgatactattttaaataaattgattggtcattactgtcaagcaattgaagtaatttgtccagatacatataaagatgaaggttttgctcaaattcaagtgagattcaacagctgaattaaagctattcaagagccagatgatgtataagtggctatagcaaactgcaagacatttgcttttgtgcatatatcttctgcacagtttgaaatgtctcaaggtaatttcaaaaaaagtaaacaccttcttcataaagctgtaaaatgtggagcagtaccactagaaatgctgcaaattgccacgcagaattgaaacctccaacaaagtagctgctttcagcgaaggaaaagagttcatcaacattgacaatattaactacccaagaatcattctctagttcattgaacatttacagaataggaacatgctgtaattaggcaattaggcaagagaaagaaaaggcatctaaatcggaaaggaggaagttaactgtctctgtttacagatgacacgatcataagtagagaaaatcctaaagactccaccaaaaaaactgttcgaactaaaaaacattcagtaaagtttcaggatacaaaatctacaaacaaaaactagtattatttcttttttttgagacaagatctcactctgttgcccacgctgaagtgcagtgttgcaatcacagctcactgcagcctcaactccctgggctcaaccaatcctcccacctcagcctcccaagtagttgggaccaccacacctggctaacttttgtattttttgtagagaaagggttttgccatgttgctcaggctggtggcaaactcgcgagctcaagcaactcacctgccttggcctcccaaagtgctgggattacagccataaaccagtatcatttctatacattaatggtgaactatatgaaaaagaaatcaagaaaatcccatttacaatacaattaaaaaaaaatatatatatatatatctagaaataaacttaaccatggtgaaaaatctctaggatgaaaactataaaacactgatgaaagaaactgaagacacaaataaatggaaagttatcctgtgttcatggattgaaagaattatttcttaaatgttcataccgtccaaagcaatctgcagattcagtgcaattcctatcaaaataccaatgacattcttcacagatagaaaaaaaaatcctaaaattcgtatgtaaccacaaaagaccttgaatagccaaagcaatcttgagcaaaaagaacaaagctggaggcatcataatacctgacttcaaaatatgccataaaactaaagttataaaaacagcatggtactggtataaaaacagatagatcaatggaacagagaacccaggaataaatccacacatttacagccaactgatattcaacaaaggcaccaagaacacacatttattgaaaagaaagtacagtctttcaataaacgatgctgggaaaactgaaaatccacatgcagaagaatgaattaaacccttatctcccaccatatacacaaatcaactcaagatgaattaaagacatagatttaagacctgaaactatgaaactgctagaggaaacacaggagaaatgcttcattacatttatatgggcaagaagtttatgaacaagacttcaaaagcacaggcaacaaaagcaaacaatgggcaaatcaaactacatcaaactaaaaagcttctgcacagcaaaggaaacaaccgatagtgaagcgacaacctatagaatgggagaaaatattatatttgcaaagtatacatccaacaaaggtttaatatctaaaatataaaaggaactcaacttaatagtaagaaaacaaataaccctgtttaaaaatggtcaaaagccctctccctctccctctccctctccccacggtctccctctccccacggtctccctctccctctctttccacggtctcccactgatgccgagccgaagctggactgtactgctgccatctcggctcactgcagcctccctgcctgattctcctgcctcagcctgccgagtgcctgcgattgcaggcgcgcgccaccatgcctgactggttttcgtatttttttggtggagacggggtttcgctgtgttggccgggctggtctccagctcctaactgcgagtgatccgccagcctcggcctcccgaggtgccgggattgcagatggagtctggttcactcagtgctcaatggtgcccaggctggagtgcagtggcgtgatctcggctcgctacaacctccacctcccagccgcctgccttggcctcccaaagtgccaagattgcagcctctgcccggccgccaccccgtctgggaagtgaggagcgtctctgcctggccgcccatcgtctgggatgtgaggagcccctctgcctggctacccagtctggaaagtgaggagcgtctctgcccggccgccatcccatctaggaagtgaggagcgcctcttcccggccgccatcccatctaggaagtgaggagcgtctctgcccggccgcccatcgtctgagatgtggggagcgcctctgccccgccgccccgtctgggatgtgaggagcgcctctacccggccgcgaccccgtctgggaggtgaggagcgtctctgcccagccgccccgtctgagaagtgaggagaccctccgcctggcaactgccccatatgagaagtgaggagcccctccgcccggcagccaccccatccgggagggaggtgggggtcagcccccgccaggccagccgccccgtccgggagggaggtgggggggtcagccccccgcccagccagccgccccgtccgggagggaggtggaggggtcagccccccgcccggccagccgccccgtccgggaggtgaggggcgcctctgcccggccgcccctactgggaagtgaggagcccctctgcccagccaccaccccgtctgggaggtgtacccaacagctcattgagaacgggccatgatgacaatggcggttttgtggaatagaaaggggggaaaggcggggaaaggattgagaaatcggatggttgccatgtctgtgtagaaagaggtggacacgggagacttttcattttgttctgtactaagaaaaattattctgccttgtgatcctgttgatcagtgaccctatccccaaccctgtgctctctgaaacatgtgctgtgtccactcagggttaaatggattaagggtggtgcaagatgtgctttgttaaacagatgcttgaaggcagcatgctcgttaagagtcatcaccactccctaatctcaagtacccagggacacaaacactgcggaaggccgcagggtcctctgcataggaaaaccagagacctttgttcacttgtttatctgctgaccctccctccactattgtcctatgaccctgccaaatccccctctgtgagaaacacccaagaatgatcaataaaaaaaaattaaaaaaaaaaaaaaaaactgtaaaaaagaaaaaaaaagagctccatatttacagctgtaatatcaaataaagtgattattttttacaacccccttaacaccttttggagatggcgtttctgttttcagaaattaacgtaaaatcaagaagcaagattccataagctcagaactctggacagctgatcaggtttacctatggtgctttgcctttaactagagtgtgtgacggtagattatttcagatatgtatgtaagactgtttcctgaacaataagatgtatgaaaggagcagaaataaataatttttctaattaaaaaaaaaaaaaacatggtcaaaagacctgaatagacttctcaaaagaagacaagcaaatggccaacaggtatatgaaaaaatgttcaacatcactaatcattaagaaaatgaaaatcaaaatcacaatgaaatatcacctcagtcacctcataccagttaaaatggccattaccaaaaagacaaaagattagctttgtttgggcctttcttggaaaaaaaaaaaaaaagacagaaggtaagtgttggcaaggatgcggagaaaaaaaaagcttttgtatgctattggaggaaatgtaaattagtatccccattaaggcaaacagtatggaggttcttcaaaatattaaaaatagaactagcatatgatccagcaatcccactactgggtatttacccaaaggaaatgaaatcagtacatcaaaaaggcatcttgcactcccacgttcactgtagcattattcattatagccaagttatggaagcaacctaagtgaccatcaagagatgaatggataagcaaaatggacatatacacaatggagtactattcagcaataaaaaagaacaaaatcttgtcatttgcaaccacatggatgaacccctggagaatattatgttaagtgaaataagccgggtacagacagtacacgatctcacttatatttagaatctataaaagcaaatctcataggagatagtagaatggtggttaccagatgcttaagtgtttgggggcagcggggaaggcagatcctggtcaacgatatatagttacagttagataaaaagaactgctgggtgtggtggctcatgcctgtgctcctagcactttgggaggccgaggcaggcagatttcttgagcccaggagtttgagaccagcctgggcaatgtggcaaaacctcatctctacaaaaaatacaaaaattagttgggcgcagtggcacacacctgtggttccagctacttgagagggtgaggcaggaggattggttgagcccaggagtttgagactgcagtgagccataattgtactactacactccagcctggggcacagagccagaccctgtctcccccaagaaaaaaaaaagagctaaaaaccagaataggcaaatatatagagacagatattagacaagtaattgcctggggccaggaggtatatggtgggggagagcagaataagggagaagagaaaaatgaaaaatgattacttatggttaagaagtttctttactgggtgatgaaaatgttctaaaattgatagtggtgatggttgtacaactctgagaacatactaaaaaccactagacagtctattttaaatggttgaattgtgtgatatgtgaattatatctcaatacagctgttttaaaaagttctgaattgttatttcttcaaaacgatggatgctttgctaaattggcaacatacactaagaacatgaatgtcattaaatacctttgcctagtggctgaaccagaatcccaaccccaggactactgttgaggccacattctaggtccccaagagtgggctccttcacaccaggcacagtacctcactataaactcagcctacagacctgatggccaagcagttccctgctgggccaaggaagggctggaggaggatggcagggccacttggatgctagccaggagcaactggaatgggaaattcttaagtgtctctgatatggcacagaatgacctcaaaactcaggtgataaaattcttggataaaaagaattgctgggtgtggtggctcacagctgtgatccaagcactttgggaggctgaggcgggcagactgcttaagcccaggagtcctgggcaacgtacaaaacctcatatctacaaaacaatataaaaattagctgggcgcagtggcacacacctgtagttccagctacttgggagggtgaggcaggaggactgcttaagcccaggagtttgagactgcagtgagccatgactgtaccactgcactccagcatgggggacaaagccagaccctgtctccctcaggaaaaaaaaaaaaaaagctaaaagccagaataggcaaatatatagagatagatattagacaagtaattgcctggggctaggaggtatatgctgcgggagagcagaacaagggagaagagaaaagatgtgcgtaccaaaaggatgtgaggccctgagcccagggcaggtaaggcatgggactgccttattttaccctggcatttaggacagtactccacaaaccacaaattcttataaatcacagccagtgaaagtatgctcaaaatccagaaagctcttttaaaaaaggtctcaacactttgagatgttagtcttgaaataagttaatgtttcaaattatattcattcctttaaatggattaaattgctatttcttgacccggcaaaattttaccttggtagatcattcaataaagcagcactgtgcccttctctaagtctgtggtgttgtaccggctcctgccatcatttttcacagctctttgaggagcaaagaggtggaggacttggtagacactaagtagcaagttgtgataagaatcagaaacagacaccaacttcttgaatctcaactaaggtttctttagccacattctacacaaagataaaatcttaagccattcattaaaatcttcaaaattatatgtatttgataataaacatcacatagagcaaatggttaagtcactaacacattctctttaacagcaatttcagttttataaaactactttcagatattgtttcattttgtatcatgatttttaagttttctcactgcagctggaattaatttcgttacaatgagaggaggaagggtttaaaaattaaaacggtgtcttctaattttaaaatgttaatttaacaaaatattccatcctatttcaacattattaaacataggccaggcgtggtggctcacgcctgtaatcccagcactttgagaggccaaggtgggtgatcacgaggtcgagatcgagaccatcctggccaacacagtgaaactccgtctctactaaaaatacaaaaattagccgggcgtggtggcatgcgcctgtagtcccagctactcgggaggctgaggcaggagaatcgcttgaacttgggaagtggaggctgcagtaagccaagatcgcgccactagcactccagactggcgacagagtgagactccgtctcaaaaaaaaaaaccaaaaaacaaacaaaaaaccattactaaacatcaaaagaatcattcaaatacactggttttatcaaaaaacatgaaaaagccaaaatataaattttcatgttagctagtcttccaatttcattttatcctaagcaacttaggtctcagttttgtaatgtgacattaatataatgtttatggatgggtgtgatggctgatgcctgtaatcccagcactttgggaggcccaggtgggcgggtggcttgagcccaggagttcaagaccagcctggacaacacagtgagaccctgtctctatgaaaaattgaaaattagctgggtgtggtggtgcacaccagtagtcccagctagtcaggaagctgaggtgggaggatgccttgagccaaggaggtcaatgcggtgagccatgattgtggcactgcactccagtctgggtgacagaatgagaccgtctcaaacaaaacaaaacaagaaaacaaaagataatgtttatcatgtccacctccacaggacaatgagatgtaattataataggaaatatgatgggtatgtttcagggagaatgagcacatctaccagtactgaatcagctttgatgttcagaaacatcaaagaaatatggtctcatcacttaacacagatgataccttagaagtttcgtttgtttctactctaaatagaagggtcttctttccagaacgacagatccgatacactgtggaagaaagaaatataaggaattacaacctaaacccaaaactggccccaggaagaaactagttggaatggcagaaggagctcccagctaagagctgtgttggctgggccagctctctaggcatcaagaggggagtggactcaggtgggcttgagtcctcagcaagagagagactccaaatgctgcagctgtgacaccccacagtgctctgagtaaccaaggcagtggcggcggggtgacagaggctgttctttctgtcactgggctccaaggggcaggagcagcggggtgaacacactgaaatgcaagactgactgtgcgctacaggccgtgctgagctagagcctctgcctggagggaaagtaccaagctcccaggcaacagctttacgaattctggctactacaccaagtctaaatacatgacgattttcacaacatcaatgagaaattgttctttaaagtctgaataaataaattctagcttttcttttcagtgtcttaaaaacaaagcaaaacagacatgagcaacatgaagtgatatgtttatccaactgtgtgttgttgaatcaacttttagttaaaatgttagagagggacaaataagtacagtgtgtcgatgtgcggtgctgtgagggcacagaccagtgatcagaacacaacacctgcggcctctcccatcctgacaaagtctctgcatgccaactccagcgacagggtgctaggacagcgcagggatgaaatactgaagggacacgtcttcatgaagcagatcaaaatgcaccatcttgttattcacaatatctgggaagagaaaagccatgattttagagacctagtgcagcacacacattttgatctctactttttcagaacagccttcccagcctgcacctcctgttttaggcatctgtcttccctgaggcagctgcagagaccacagtctctcactctcactgccacagctgaggctacatcacggccccagcactggcggctccctgtgcgaggagaggaaaagtgaagcggcccaagcccttggcaaaacacccagcaggctggcttcctggcaaaccacattcacccacatgagcatccttctgcagcgaagagcagctcctcaccagtgagtggaggaactgtgctgagaagagccaagagccaggatcccccaacacctggggcaggctgtgtcacacactgctacatgggatggatccctgcatctcaacggtcctgccaatcccgtgagggccatgggtgatggctaaaatccaaggcatcaggcatgcaaccaagcagggaagtaaagagcacatgagggtgggcaggagcacacagtgtgacaaccaccgagagctcggggagctgcagcacagcagccgaggaaagctctccagcagatatgagtgagtgacaagaaaccatgtgtgagcaggctgcagagaggccaatcccaggagatgggaggttggggaaaggaccagaaaggacaagcaggagacaaacattctttaggagaggtggtgcaagggcacaggagaggcagagactgagggtggcaggacctagctagaggaggggacaattgagccgacacctgaaggagactaacagagacagaaaaggggctttgggaagttaagaaggtatgagaagttcaacccacggtgttttaaaaaaaatttttgctacatcacaatttgctggtcttcctttctctgctacacgtggagacaccaaagtgaatgttgggaagacacttggcttagtcaaccacctttgataagaactcttccatgttcctcaacagccttggattcagaaagtccccaaaataccaagttcaaagactgatgttgtgcagcgcaggggccccccacaccctgtgtttccacactctgcagacaggaggggtatttcactctctcaccattcacactgtgcttgtcaggaccaagggtctgggcattgtacaggagcttgggagaagtgcagccatgaggcccagcccaaactatgaataaggagtccctttacatgaccttcaggcgatctccatgcacatcgaggttctcagaagcacctttaaggaccctgcactgccacacagctcccactatgctcagccctagaaatatgacatcgtccatgtcaaagttccttaaaatgcagcacaggtacctcaccccaaaactccccatgatctggcctagtctagcttctccatctctaccctcagagctgcttctctggcgatatctccttctgtgcccatcactccaactgtgtgacaccttccccaattcccaaacacccattgcccctcccatggtctcttctgattctcttcatgtctctcattcaaaagggctggtccttgacattgccacctagaatcttctgttccttctctacagcacactgcagatctgaaggggatgaggtgcagtgttggctcaacctccctctcagctcagcctgggagctatgctacaaaacgtggaacttcaaatccaggatgcagtcgcttttaggttgctgtgatttcagtagtaaggtgacaaaaatgccttgaaaagctcttggcaggtaatgcctttctcatgtgtggtcagtagatgaagagtgctggagcaggtgtgtgacctcacaagatggggcccagccagaatcaagaggcaactgttaacaaccagcagccaagggacagatatggggcagcgaatgcaggccagcatagccacagaaaggaaacaagacatcacaagggaaaacttaaatccaagccaaaccgtgtctggcactctgagcaggtcaaattagatgaccatggagaaggtgggatgatctgcacccattctcccgatggcatctccaggtgtgctggccaactgaggcagcacacaacccacctaccaaccagtgtggctgcaggtttcaggccctaacagagtgcccaggggttgtttctctgctgccaccttaggtacttctgaatctaggaaaatttaaaaaaccccactgttctaggaagttaaagtccacataattgagcttttttttttttttttggatttatgagactatatgcaatctgttagactagagttgactgcagtatttagaatatgaaagaatatgaaaaacaaaacagagaagcacactcactgcataaggcctttgtgggatttacttgttgtccagcaagaaactgtaggagcttcctaatatctatgtgcacttcagccatgtgttccacgtttctgtcctcatgggtgctttcagaggctaaaatgataggaatgcatttaaatacaacatcttcccacgtaacaggaaacctggagatactcaatgcattttacttaaataaatgattcactttagcactgattttagcatcctgaagaaatattgcaacttgtaaatgttgtcattcattaagcattaggtcctaactatttaaaatactatgataatttccaaggcatctttatttacaggggacttgaaatataactcaatctccctcttcaggtcaaagaaaattttatttatttgtacttactatgtattttaagagtgaaaatatatacattaactaatacaaggcctgtcattctggagtggaattaaaaaaaaaaagaaaacatcctttctacctctgagaaagtaccaaagataagtcccaccttatgtttattaaaagaaacaaaatgagtgacatcagaatgaatcgctttacacaatattatcaaaggcataaccgtatggatttcactctgctggagcaggatgctcttaactagaaagtaaaaattccttccaactctatgctaaaatctgtgtttatattcaagcagactcgtagtaacttaaatgtgactagggccgattttattggttctggcacacttatgtatcataaaatgattttctcatcatccccaggtgtttctcccctggtcctttacctgctttcctgctcaggcagcccctgctactgtgcagctgccactttccagccatgattctaaccccctcttggcttataactcaccaaactgtccaaccgtcccctctctccccacttgctgaactgactctatcgtcccttattaccttgtatgagataagaaatgtgatcaagtgaaacagttttgcatctgctacactaatttcatacatatggaagtaactgaaggaggagaatataagaacaaatgtatctacctttctgaatccatgccaggtgagaaatagaaatctttaggagtaggacaggaattgaatagctggaagggatcttggaggttatgtaacttgatccgaattctacagaggatggagaccctgcacagatctgtcagctacttggtggcacagcttctccccctggtggctaactgccccactacaccacagggatacatagtccagtctcaattcctttgttcttcacccaagcatgaaacaaagtcaactgaatttcaacctttttacatgaagagacctcaacaggtaggttatctgaaacaattaacttatccaaagcaaaatataacccactagaaaacttacctaatggaggatttccaagatctttaaaatgagttgtaacacatactaattcagtttctattttcaaattcaattctccatctaggtttgcttcaataacctgcaaattgagtattttacatagtcttagaaaaggaagccaaaaggaaaaaaactccatgggcaacagctttcacacaaccagatgacaaagtaccctacaaaacctcaaaacacctcagagcacactgagacccccgtgctatcagggaaagtgagaagataaggcccaagagccaagaactcagaaatctcccaaaaatctcaaaggggaagtccccctgcctgcctcccggaatgaagaactcagtgaagatgtgaaaacaggtggaactccgagaggacttgccaggagactacagcagcacaagggcagggctctagggagggctgggtggagctgatgagaactccctcacagcaggagagagtcctgcactgagaaggaaccacgggaagtaagagcctcaactaagcagaatgggcaccttgggcaaaaaaaagggaatgaaactttaaatgaaggaaaaagagggacagatctcagaaagtcctggggatgtggtgaggatgcatgttttaatattttgtggttacaaagaatagagaattctagagtcattaaattagaaaactattttggtccactttcactcctacaatgaaacttcctcctaaaagaaccagaaaaaccagccgggcgcggtggctctcgcttgtaatcccagcactttgggaggccgaggcgggcggatcacgaggtcaggagatcaagaccatcctggctaacacggtgaaaccccgtctctactaaaaatacaaaaaattagccgggcgtggtggcgggcgcctgtagtcccagctactcgggaggctgaggcaggagaatggcatgaacccgggaggcggaacttgcagtgagccgagattgcgccactgcactccagcctgggtgaaagagcgagactctgtctcaaaaaaaaaaaaaaaaaaaaaagagaaatgaacaataatagacgctatgacacaacaacataaatcagaattagggaagctcagacatgagatgaccagagagcacgcacataaaacacagctgacagcacaggaagtaattagaaacataaggaaaaatttcagaaacagaaactagtttagaaggaagactagagcaaataggcaccacagagagaatagtaagagaaactgggatggaaaggagaaagataaaatttaccaaacagaaacaaagagttaaaaggatctgacagaaaataataaagacagtggagaagatccaagccctctgagtcccagaagaaaaacaaagcactggaaaagaaatgctatcaactacagctcaaaactttcctgaagtgaatgaagagttcggcccacatattgaaaggacacaccacacacctgggaaaactgaccccggatggtcaagacaattggattgaaagaaaaatgggaaaaatccccagggtatttagtccccactttcaaatgaataaatccaagctgtgaaacaaaatcagaatggagtcattctttttgatagcaataatatacaccagcagacaatgcagtgcagtgagccaaactgacattataaacacatgataaccaatgaaatcctattcctgtgagtccttcttgagtgatatgctagagaataggcttttaataaccaaaaaaatcattggagaagttacagcataaacagtgtgagccttattttgacctttagaaccaaaactaaacaacaggaatgaagaggacagaataacgtgtagtaataaaattttatgctctgatgatgtagacataatataaccattacaaaacaggaagggggaaaatgagaagaatgtggaaatcagtgtcttatttttataaaatataaatcaaccatttgtcataaacacacatttaatatgactataaggccttcagaatctcatgagaacatagccatttatttagaaaataaactcacatgttggaaaatgaaatgtccaaatccagaagggtctggggctgctgttgggttaccaggactgaggatggctgagccaaactccacacgcccaggctaccagacttctgccatcccctcatataccatcgggcacccctcttctactcctgctcttgctgcccggggactgtctccacaggtcacaagggactcctttcctttgaagctcctctacccaccccaacaaccaatcagttcttttaattggatggaacctagaagtgaagcatatgccacagtatggtttgaggttttgctaacctatcctggtccactcccgcacctacaatgaaatttcctcctaaaagaaccagtacctgttatttctctttttgatgttgatatctgcccaatgttaaagcctaggaggtctctggaaagccagtgtgtagtctgctggatagcattttgccatctagtactagaaaagtgccacctagcaactggtcttatttagggccattccatcctcacagtgtcacagaaagaaaacagagaaggcactctgtctgcacggctctgtatcagtgttcatgtttactgaatacaatttagtgttccttgttcttattccttaaaattggtgaactctgaatagttttcattccagaaacaaagtttttctaatttgggtgagctcttatttctgagcttttcacattaatagaaaaatagtgccccaaacttacctgttgtataatctactttgaatgagaaatactcattttcaacccttttctttcattaatccaaaaaaatatattgttatatttcctaacccgttttcctacaatctggaacaatagttgactgaaataaaatatataaaacaatctttgtgaatatgctagactgcttagtggggctaaggctaacacatgaccttagctcatttgttccaaacaaccacacacccaagatctgtaaattcccattgttttgaaaagcaatggttttagatataaataaataaatacttacttaaaaatgcaacttgcaatgggcctagatgcacttcaggcttaaatgttctcttgtgttttcttcaaattcctaagaatctcagtaacagaacattagattccaactccctcctaaccattaacacctggtgcctagcacatggtggccttaagtcaatacttactgaagaaactaacaaacaactaattctctgaacactggtcactcatgtctattttaagattcagttatttgggatattatacacaacaacacacttgatttcttaagtatcagggtaagatctttcaatgatttccttaaaatagtcaactattgtttatagaatgctgactatactgggcacctagtaaaaattatctctaaatttttaaaaactgacgaagcccctgtcatagctgcactgttatccccatttggggtagtatccagcactagggtactcactgcacagcgcagcctggagctgaacccaggtatgtggctccaatgactcccctcttccatatcatgactcctaaacatagactctggtttctatcattaggtgaccctgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggggcagcttttcccatgctgttctcttgatagtgagggagttctcatgagatctgatggttttaaaaatggcagtttttcctgtgttcttctctctccagctgccatgttaagacgtgccttgcttcccctttgccttctgtcatgactgtaagtttcctgaggcctcctcagctatacaggactgtgagtcaattaaacctcttttgtttataaattacctggtctcaggtaatatctttttagcagcgtgaaaacggagtaatacaggcacacatcacaaagtactgctacatgatgtggtctgaagacaggcagcatcgacatctcccaggagctggtcagaaacagagcctcaggctccagctcagacctcccaaatcagaacctgcactttaaccagattccaggggattcacacgcatggtagaacttagaagcaatgtcttagaacatgatgtcaattccctccagttcttgcttctttttctgctcctgcatgagtcacatacaacccaccccatcagtcacacctcgcatttaatgaaaggaagtaactgggcatctctaatgggaaggtgggcatttttagtgtgttaagtctacccattttccttaattctactgcctgtaatattcagatacagaattctggatacccaggaagacctcattatgtactttgctacagtaacttgataactttccatttagtaattccagatcgtagtagcctctccacaatatttctatgtttttttaaactccaaaaaagagaaaacaaaacacctctgatgattctaagctacccttctacctctctaccttgctgactcattttcattgaacagaaagaacaaacaaatgccatccttcaattaacagccctgtcttttctctcctgggcctctctgaatttctctggaagtccccagggtatccccagatgaagccagcctgacaactggatcagcatcactgcagtcacaggtgacaccaacgtcagcacagtgcacactgcttcatggaaaacagattttatagattaagttatgaaggaaaagctttgagttacccaggtccaatgacagcattgctcttagtgtgcagaactctagaaaaaaacagtcaaatgtacattttctaggcttcaaaatacttttgtgatttcaaagacctcttgaagctaaattttgttccagatccatgcaacacttattgctgcctactgagtggcaatcccacactgggcagctgggacacaaagatgattaagatggggtttcctttatcaagaagctggtggttcacgagaccttcagagatcttagcaggtgatttaccatgtacactggacagctcagctccatggaggagcttccagaggggtggtggggaaaggtctgtgatgaagcatgagaatggctaagtgccttccagggagatggagagaagaagccatgtgtcaaatggcaaagaaactgaacaaaaaagaagaggcattgtgggggaataccagaacccagcctcgttctgcagggagggtgtggcaatacaacagagatgtggctataaaggtggcctggtacactgtcaagatcaaaagtttatgcttcatcaggtggacagtggtttttagaagattcagggacataaccaagggtgttttttggagcaggataggagggagcagggggaggagggaggggcagtgagtgaaggaagaattcacaataaccccaggtatgaatgaggataacctacacatttcccaccactgtcacacactgtaacatttcgagccatgtggccataggagacttccacaaaataaacagaaaataaacagaaatataaaagtgccccctagcttggtgtgaggtgtgcttggaataaaggctgctatggtgtggcatatctttgtccctggctcactgaaagacacttggcacgcagacaggaaactccaaactcactgtcagtcatatcagtgactcacagaaaaatacgggcacgttagcaggtaaaagatacaatgttccagccgggcgcggtggctcacgcctgtaatcccagtactttgggaggcctaggcgggcggaccacgaggtcaggagatcgagaccatcctggctaacacggtgaaaccccgtctgtactaaaaatacgaaacaaaaaattagccaggcatggtggcaggcgcctgtagtcccagctactcgggaggctgaggtgggagaatggcatgaacccgggaggcggagcttacagtgaggtgagatggcgccattgcactccagcctgggcgacagagtgagactctgtctcaaaaaaaaaaaaaaaaaagaaagatacaatgtttcatacaaaatataagaggaaaaacaggcagattaaaggcaaatataaaagctttcctcaaagaattagagttgaaaagtattggaataggtttctaaatccaactagcaatctgcaggttctcagcaccaggccaggtcctcataagtgggaactcggttaggaggtgcccacctgcatggactgctgcagggtgagctggagaacccacgccgtcccaccaaatacttcagagttcttttctaaagaagttgtgacttacaaggtgattgctgatgtttttcattttttccacaacactcttcatagtcttcaagactggtaaataaatactaacctacaaaaccaatgagaaaaaagcacaagtattaaaaatattaatatactctagtaatgacaagggccccataactaactctagaacacatgcatgctcaaaaactatgggatactattttacaattttctgaataaagttcttttaaaaatataaaaagaaaaccaattctatttcactaactcaaggatgctcaagcaaaattaaagaatggaatgcctgcctctggttacctcagcaaccatgtccctgtgggcattcttttggctcaagaaggaatagggtacttcagctgagatgcccctatattggtccagggggaatataactcaggcaatcagcaggaggccctcctctaagggacatttacacctatgattcaagggccttttccatgctctgtacaaaaacatggcagacagtcactgcatcacatctgagactgttaccaagagtgctctataaaacacaggctttttcaaaatcagtgtaggtgccatctagtaaaagtcaagtaattattttacccagcatatttctgtactttcttcttaaacaaattgtgagcaagaggaaatgggccctttggcatcatctttactttcaggagctctagggttaaccatcggcatgaccgttaccccatgttagccctaagccatgaaattcttctcttcttggctttcgtgcacatccagatatcgctcctgaccggctgaggaaaagatcaagtcctgtgaaacccaaattggtgtctaaggccaagaatactaataaatactaattgtcctccaaaagtatcatttgtgttttaagtgatgttactgagcgagacattttctacatataggatggcatgacatttctatcatatgcaacatttttaagatgctttatgtaaataacaaaaggcaaataatctaatgttttcgttaagtatcctttaaaaataaaatatactgcaagactacaactaaaactagagaattcaagtcatgccatttaatgtggggtgtacagcaggactgcaggcatcacctacatcaggatctgggaccaccggttcttgtaagtccttccacaatttcctaggaatcacctttatggggatgtcatgggtcacaatgcggctactgcttgacatagataactgccaagaaaagaatttaaaaatatttttatgttgttaatattaagcaacaacaaaacaaacccgaagacccgggacaaaaaagttgaaataccaaatctaagtggaatgctgtcagtttattcactcaaaagccattcgaccaatattgatggtgccaatatttatggaacagactctgggtacttccaggaactgggaagtgtggtgataagacaaaaaggtccttagtgttccagtggaacaaacagatcaataaaaatgcaaacaaatgaaactgtatgaaatgctcattatagccgtgagaaagcactccacagagaccagggtgagtgtgggggagtttccttagactgaggaggtgacatttcagataccaccaaaagcaggagaagcagcagccatgggaagacaagaacaaggggacagggtttcaggctggggaaacagcacatgtaaagccgtgaggcagaaagaagcaagcctgctatgttgacgcaaccaagagaaggccattctttgggcataggacactcagagtgctgcagtttctaacagttaaaaggcaaactatatttatttctaggggctcctatgagactcacagaccaaaatatcttgcacttttggacaaaaagtattatacgttactatcttgcttttccttaagcaatagaaaaaacataccaaacttatactgtgacatgaaatgccctaattagctctgagaactgcctgactgcaaagagttgagagttatgaagaaaagctgggctgggcgccgtggctcatgcctacaatcgcagcactttgggaggccgaggtaggtggatcacttgacgtcaggagttcgagaccagcctggccaatatggtgataccccgactctactaaaaaaatacaaaaattagctgggtgtggtggtgggtgcctgtaattccagctactcaggaggctgaggcatgagaatcgcttgaacccgggagatggaggttgcagtgagccgagatcgcgccactgcactccagcctgggtgatagagagactccgtctcaaaaaaaaggaaatacgaacctcattctatgagtaggaagagcaactctggattgtatgtatgcgcatgagtttgtgtatttgtgtgtttggaggacagctgtgcactaaattcatctggcagtagcatataaaacatacgtgtactgaagaacgaggggccatttaaaggttattatagcagatgaggcagggtgggagtggggagaaaacatgtcaaaggtgaaaatggatagagaaaccatgatttctagacaaggtgacaataccactacaagaaacagagaggctggaagtttcacggcttggaaaaagcagcattctagctgaatgcatatgataacaacacaattttaaaatgaggaggaactgactctaatgcaaaatatagttatggaccagatctttaaatttaaataaaccaaacagctttcaacagtatttattgttaaaaaggctaggctaactatgtctattccttcgaggccaagacttctgtgttagaaaccctgactctcctactcaccagctccacggagaccgtgaggcagggaaagtgtttattagtcagtttgattttcaaagccctggcattctgggcagtcttcaaggctcgagataagttttccgatgttagctctaaataaatctcattgttttctgcagagacaccctccatttgaaattcgttgaagaagttctcctaagggaaaaaaaatgagggatgagggagggtatatgtgatctttccagtgacaatctgcagagtgtgcaggcctctcagaagcttttgctcacctgttccagctcacaccacatgctcactcctccattagccagcttgtcacaaaggatgaagttaagcttatcagggctgatgcggagggtgcaggttttggcaagcttggctatcatgttactgattcctaaagcaggggttaaaataaggaattactaaaatgcacattatgtatcctagagaccaacttattttgcagaatttcttgttcatcaacttctcggtggaaaaataaccacttaacgttggtatcacactggaaagtactttaatacccctgatgtcacgcaattctcccaacaaactaggggagatgtacagcacacatcatcagtgttcaaataagaaaacaggcacctaccagtcattcattcattcaacatggatttattgactactaggtactgcaatacacagttaaatgcaaggttaggcactgtcagggtggagggacgaatggggccttgaaggtatgtcaatgcctgataaagccgtctatgggagcagtggccgcttttttttaaagccacgtgatcggaatcaagtttcagaaacgtcccttgaaagccgccttcatccccacaagtgccctccgacccgccccgcgccctcccggccccaccctcccgcggcctacaccagcacccccatcccggccccatcctcccgcggccccttccggcgcccatccccgttctgatcctcctgcgcggtccccaccgcgcgctcactgcttccttccgttcctccctcgctcctctccggcctccctgctcacgtgtgaagtggttcagacaggccccgtccacgatcttggcccgaaacttcatggccgcggatggcgcagccgcggcgggcctctgtgggtaacagaaaagcgtcgcgccctgagtgtccccgcccggaaacacggcagcgcgaacagtggttccgcccggctcgggctacgcgactcttaccagggttatctccgggccacgccccggaggaggtggggctagggggtcacgccctagaggaggtggggtcacgggtcaaggatcacaggtcacgccccgggggaggtgggggtcccagtctccgggtatgcctccgcgctgccgggtaatggtgggatctacttttagtgaggcggaggcttcaagccccagattcggggaggttgttctgagaattcacgttttgaaagaattttgtgacacctatttcaagtgttattttaaaatatccaaataaaattaatcgtttataaaggttaaacaatattatcttaaatatacctaaggtagagcagctttaaaccctccagcctcagatgacggtactggtactttggtattgaagcatcttggtggattaaggttctgaaaattgtttcaaatgacttctaaaaaaattgaacatattactggctagttggtaaagtcgggaagcttaaagaacactgacgttaagtgataattctgcagtttgcctcaagacgaactttattacatccgataaaattcttattagcataaataatgtcattaggattttttttaaaggaaaaattttaaagggggaaatgaagcaacaattgtatctaatttggtttttcaaagactaaagattatctgtgttaacaattgttatttttaatgtcctttgcaaatagactagaaccttgtctttaacttgacacatagaatcaagataatgataatgcagatgatgatgatgatgattttgagacggagtctggctctgtcgccctggctggagtgcaatggcgtgatcttggcccactgcaacctccacctcccgggttcgagggattctcctgcctcagcttcccaagtagttgggattacaggcacaagctaccatgcccggctaatttttgtattattagtagagacggggtttcgccatgttggccaggctggtctcgaactcctgacctcaggtgatctgcccacctcggcctcccaaagtgctgggattataggcgtgagccaccgcgccaggcccagataattttcaaagacacatgcacacatatgtttattgtggcactattcacaatagcaaagacttggaaccatcccaaatgtccatcaataatagactggataaggaaaatgtggcacatatacaccatggaatactatgcagccataaaaaaggatgagttcatgtcctttgcagggacatggatgaagctggaaaccatcattctcagcaaaatatcacaaggacagaaaaccaaacaccgcatgttctcactcataagtgggagttgaacaatgagaacacatggacacagggaggggaatatcacacactggggcctgttggggggtggaggcctgggggagggatagcgttaggagaaatacctaatgtaaatgatgagttgatgggtgcagcacaccaacatggcacatgcatacctatgtaacaaatctgcacgttgtgcacatgtaccctagaacttaaagtgtaataataataaaaaggtgcaaaatacaaaaattgcagtttttgcctattttaagactataacatgaagcaaaattctaatcttcattgtcatatgcgagtgtttgccaaaccaaacttaatagatcactttcaaagttatgccaacaggcagggcaggatggctctctcctgtaatcccagcattctgggaggccgaggcgggtggatcatctgaggtcaggagtctgagatcagcctggccaacatgatgaaaccccgtctctactaaaaatacaaaaattagcccggcgtgatagcttgtgcctgtaatcccaactactcaggaatctgaggcaggagaatcacttgaacccaggaggcggagatttcagtgaacagaggtctgccactgcactccagcctgggcgacagagcgagactccgtctcaaaaaaaaaaaaaaatgttggcataactctttttttttttggagacggaatctcgctctgtcgcccaggctggagtgcagtggcgcaatctcggctcactgcaagttccgcctcccgggttcacgccattctcctacctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaagcgtgagccactgagcccggccatgccaacattttttatttgccccatatgatctgcaggaaaaagcctgttttttaatttcctcatgaatgagttttgaagagttgagcatcacattaaataaagtggctgctagtagataaatgaatataattaaagaatgtatctaaataaactttgtaaacaatgttttgtaacatcttgatctttagtgtaaattgcttaattttatgtcataaaaactgataaagcaattttttaaacttcctaagaagatgtgatatgatacattctgcatggacaaaagcccaaataatataggaatttgactcaagaaatagaaaataaagctgcaattatcttttcttggaagaagaaaggaatcttttatgtgctcttgcaattttcttaaacaggtttagcaaattaattcattaacttcagaattgacaattaagtatattgacactacttctctactttccaaatgattttgaggcaaggaatgtgatctctagagatttctagaagccccatgtaccactgagttttctaatgcaatgtatattcatgttctcatctagctacagtaaattgccttctgacttaagaactgccaaatgtcagggattagtaattcagtcacacaatgatttgggaaacagtgttcacgctgttcattaagtttgtttagtggggaggtaaatgccttaatcttgtcttagaaactgaaataaacagtggtgcaaataaaatgtcattcaggatgcatatagttggaagtaagggaaataacctctctacagctgcagatggtaaactctgtctaggtaagtatttggccagtctctttcaggtacttactcatcttctctagtccctgggggaagagacagcaatttgcagccctgttgttagcagttaatgttggaaaaattacccaagggaaacaacgtgactagctcacatgttacgcatcaaatttgaaaggcagtatttgtcttctttttttaacatgagaaaactgtaaaatgaaggaaagcataccctagaggtggcatgagtgaatgtcttttgacaactgtacttgttctaagagatgggtttttgcttaagcagctcttcaaagactcttctcctcttttaggtgtcaaaaaaattcttcaataaattccatagatacttttctaaatgaagatttgtggagcacatgagaagtgtcaggcatggtggtgagtgatggggattaaggaaggggaccagcccctactcaagaggagggtgatcaacatttattggatgcctttaaagcactatttaaatattattgatcagtagggtgagatagatagctctcattttatagcactctgcactgatatcatcacttagataatataaacacacgtaaaataagtatgattattcccattttattttattttattttattttagatggagtcttgctcttgttgcccaagctggagtgcaatggtgcaatctcgactcactgcaacctctgagtcctgggttcaagtgattcttttgcctcagtctaccgagtagctgggattacaggcacctgccactacacccagaccattttttgtatttttagtagagatggggtttcactgtgttggccaggctggtctcaaactcatgacatcaggtgagctgcctgcttcagcctcccaaagtgctgggattacaggtgtgagccacaatgctcggcctattattcccattttaaagatggggacagatagaattggcaatgttggccatggcatgccctacctcacactcttgatgagaatctgcatcactggattgctgagtgtccagtgacccacatgctcctgctgactggaccagctctatttacacttgaccttcaggaaaacaattgatagtgtggaaataaatgaagaccaaccaaatggaacaggcaaagcctatttattcagagtcagccattatcacttgcatttcagcagagactcaaaggcaggcagagaggtaggaacgcttcatagtggaaaaggaaggagagtatagtgaagtaacagaagaggttacagagcatgtttatttaccagctaaagctaaagtggcaaaggaaggagaggttcatccctacccttctgcacccccttatttcctcctgggaaatattactgatgaataacattttatatacggcattttgcacatggtaagttttttagtcaaaggatatattcatctcgatttttatagataggccaagttccctccataaatgttatacctatttgcatttcttccagcaacgtgtgagagatcctgtttccccaaagccttggaataaaacattatcaaacttttggatctttctaatttcatcagtgaaacatggtacagtataatttttgccatttttcttaagtaaataagcttgaatatctttcatgtgcgtctctagatgatctgtttactggccatttttctattgggttattgatattataattgctttcttgggactgtgtatatattggaaagattggtccttataatgtcagttgtgaatattttttgcattttaagttttgttggccatgcagaggttcttgatttttatatagtggaattttttttcttttgtggcttctaaattttgagtcatatttaggaagaccttcctctattcaataccatacaggaattatcccaagtttccttgttaatatttttatggttttattacctacttgtatatattttaccatactgggagtttgtcatattgtaaagtgagaaatatggatggaattttattttcttaatgactggataattgtcccaagccatttgtttttttcccccatactcttttgagatgctaccattatcatacacccaacttccacatacatgtaaatatatttttggacttgtctgttgttgggaacaggccccccaaaatctggccataaagtggccccaaaactggccataaacaaaacctctgcagcactgtgacatgttcatgatggccataacgcccacgctggaaggtggtgggcttaccggaatgagggcaaggaacacctggcccacccagggcggaaaactgcttaaaggcattcttaagccacaaacaatagcatgagctatctgtgccttaaggacatgctcctgctgccattaactagcccaacctattcctttaattcagcccatccctttgttccccataaggaatacttttagttaacttaagatctatagaaacaatgctaatgactggcttgctgttaataaatatgtggataaatctctgttcggggctctcagctctgaaggctgtgagacccgtgatttcccacttcacacctctatatttctgtgtgtgtgtctttaattcctctagcgccgctgggttagggtctccccgaccaagctggtctcggcagtctgttccattggtctatctgtttgccagtatcatacagttttaactattgttttatacctatgtcatagagctatttctttttgttgattttttttcagagatttttctggctgtccttttgctaagtttatatttccatatgaactttagaatcaattttatttaaaacatacccccctttgggtttttaaaaatatatacatgtcttaatttttaaaaaactttttaattgaaaatatcgaacatatataaatctagacagaataatataatgaagctccatggactggcagcattcaacttcaatgatcatttcatggccaatctttttcatgaattttcttatccatttcttcctcttatgttattatggaaaagatcccacatatatcatttcaactttaaatatttaaatatgtaaataaaaagatttattttaaaatcatcattttagtaccattatcatacagacacctataatttatttttttcagacagggtcttgctctgccgcccaggcaggagcacagtgatcatggctcactgcagcctcaaattcttgggctcaagtgatcctcccacctcagccttccaagtagctggaactgcaggtgtgcactgccatgcccagctaatttttttatttttaatagagacagggtctcactatgtcacccaggctcatcttgaactcctggagtcaagcagtccttctaccttggcctcccaaagtgctgagattataggtgtgagccaccgtgcccagcccaaattattttttttaacgataattctttaatatctcataactgtcccataaagtccatatttttctgctttttaactgagatcaagttacatttataaattaacttagaactgacatcttgacagttgagttttcccattgaaggatacagtatatggtacatctatttttccatttattttactgaagtcttctttttttttttttctccagacagggtcgcccaggctggagcgtagtggctcgaacacagctcacttgaagcttcaacctcccgggctcaagtgatcctcccacctgtctcctgagtagctgcaactacaggcatgtgccaagacgtctggctaatttttaaattttttgtagggatggggtcttgctgtgttgcccagactggtctcaaactcctgggctcaagtgatcccccaacccttggcctcccaaagtgctaagattacagttgtgagccactgtgcctggccttaagtcttcttttagtcattcactgctgtttgggatttttttcacatagatattttactttcttcttttatttgatgtttattatctaaagataataatggattttgtaagttataccctgttgtttttatgaatgatattgatttatatatgggaattttgcatccacgaacttacaacagtttttccttgtttctaattcttttaaaatagactctattgcatttcaaggaattcatcaaattatctgcaaatggtcatggtcagaactcctcactaatttttacctccaatttaaaaattactggtttcctatctaattgcgctgaccagtgcctccagatcagcactaaatgatagtagtgatagtggacatccatgcctggtgtaaataaatgagtccgtgaaggcaaagatgctattatgggaaagactgatgatgagactatcttcttctaaatacaaaatgagttttcaatgctctaacaacatgaagcatccttaaagactaaactatggcaaggatatttaatttacttccatatttttttattagtaaaatgcatttactttttacaggcaagtatgaaccactttgaggttttcttcccactcccaattctcaattcctatgggtgcggtatcatctaagagaataagcattcttgaatattctggacatgtggcatggccttctgtaccaactcttctagatgtgcttgcctggtgtgccatggaccctgaatcgatataaacaagtatacttcgggtgtccccagttgctaaagatattaagtttcacacataataaatattcagaaactgcatgctgaaaataaagaaaagaaaatcaatgccttataacgaaattcatctcaaagaatcccaatgaatactgatataattttaaattatatactttttttttttcgagataggatctggctctgtcacacaggctggaatgcagtggcatgatcatggctcattgccacctctacctcctgggctcaagtcatcctcccagctcagacccccgagtagctggaactacaggcacacgccaccgcacctagctaatttattaattttttgtagagacagggttttgccatgttgcccaggctggtcttgaactccagggctcaaatgatttacctgcctaggcctccaaaagtgatgggattacaggtgtaagccaccacgcctggcctatatactttttcttttctaacataactattttcaaatatcagtctaatgaatgagaaaataagctactggaataaagagcttatgaaaagataagtagagggagaggaggataatatggcggccaagtgacctctctattccgctgtttcccccctctacactccttgctggctgtgccgaggagcaggggcaagagggcttgttgtctaaaaaccagaactatgaagccaactataagaacagataatatgagcccaaatgcatatgaatacataatcaaatatgaagctctacaaatatgctcatttctaacatatatgtattgttttacctttattttctcactatttggccaaaaagtgtcataaaacacttgtttttacatgatataaaatgtcttctacatctcttcagttactccctgtggctaatttaaaaaatgaggatatatttcatttgccttggtgagtttcaggggatttataagctaacagttgatattttctcccactgggttaggagttttacttgtattatctgatattaaatctttatcctctattcctttgagcttctctctgcctctgtccacttcatattgtaccatcatcttcctcccctatactcaagcaaggtgaggtagtaactattacacttaatagtattcagggaatggaatagttaagaaagaaccaagaaattaaatatatatattataaaaaagtgatagcagatgaggaagaatttgacttagaaactgcttttgcatttgtctgtcttttgcattaaaatcctcgtaagcacttcgagctcagaattgaagatcagataagccttgtgtaactcacgcttttgtcataattattctcatacgtcactttacatgaagcaatcccaacaaatttctcccagtgatagagctactcatatcatttcccagagcatacattacctggagttcaaatgtttgaacggtggttcctgttttgttatatataaactgacctaggaaaatttcttctccttcacatttttttgtgatgccctataaagaaagcaacagatatagagattgtaatgaatggatgcagttgtgttttcaaaaagaaccaacaattcaccaaatatctctgtgtgtccaccaggggcacagtgctgtgatcatgccagtactaacctatacacccagaggatatttaacaaggggtcaatgaggcccaaggctgatcacgggactgactaaaaggatagaagatggatggacacacagacagatagatagatagatagagagctagatagatagatccatagatagatagttagaagatagatgattgacaaacagctgatagatggaagacagatacatacatatagagcaaatcccaacattaactttgacctgataactatatttgcaataagcatactttgaataaaataaaaatgcgtcgccatactgaactgatgtttaccaaaatgagataaacataagcccattgccagattttgatcacacaaataatttcctctgaaaagtaagctcccgttgactgacaaaaacactgatttttttctttgtatgcaatttctcttgtgctttttgttcttctctacccttcaaattgaagatttgtgagaggataacgcactggtgcaaactaatttattttgtgaatctgaagtttattgttaggttccttaaattgtaacacagcaaaataaacagtacattcattaaatcattttataataaaaatattaatatcaaactataacatttttattaaaagagttggatacatcatggttacataatgtactcacaattatatatgtatgtggggaaaagagagatcagactgttactgtctctacgtagaaagaagtaggcataagagactccattttgttctgtactaagaaaaattcttctaccttgagatgctgttaatttgtaaccctaccccaaccctgtgctggctgaaacatgtgctgtgtcaactcaaggttaaatggattaagggctgtgcaggatgtgctttgtcaaacaaatgcttgaaggcagcatgcttgttaagtcatcaccactccctactctcaagtacccagggacacaaaacactgcggaaggccgcagggacctctgtctaggaaagccaggtattgtccaaggtttctccccatgtgatagtctgaaatatggcctcacgggaagggaaagacctgaccatcccccagcccgacacccgtaaagggtctgtgctgaggaggatcagtaaaagaggaaggcctctttgcagctgagatcagaggaaggcatctgtctcctgctcgtccctgggcaatggaatgtctcggtgtaaaacccgattgaatatcccatctcctgagataggagaaaaccgccttagggctggaggtaagacatgctggcagcaatattgctctttaaggcattgagatgtttatgtatatgcacatcaaaagcacagcacttttttctttaccttatgatgcagagacatttgttcacatgttttcctgctgaccctctctccactattaccctattgtcctgccacatcccccctctccgagaaacaccccataatgatcaataaatactaagggaactcagagactggtgccggcgcgggtcctccgtatgctgagcgctggtcccctgggcccactcttctttctctatactttgtctctttgtctctttcttttctcaagtctctcgttccacctgacgagaaacgcccacaggtggggaggggcaggccaccccttcatatgtacacatgactcaagcctcatatattctctttagcttaagacaggagtgctagttttatttctacctcctttatcaccttgttgggtttttttaagaaacaggatctgatggaatactatgcagccataaaaaagaacaagatcgtgtcctttgcagggacatggatggagctggaggccgttatccacagcaaactaacacaggaacagaaaaacaaatactctatgttctcacttgtaagtgggagctaaataatgagaacacatgaacacaaagcggagcaacagacactgagatctacttgagggtggggggtgggaggagggagaggagcagagaaatacctgttgggtattactacttaccgcctgtataacaaacctgcacatatacctctgaacctaaaataaaagttaaaataaaaaacaaataaacaacaaaacaaaacaaaccaaaaaaacggggtctggccatgctgcccaggctggcctcgaattcctgggctccagtgatcctcctgctttagccttttaaggagctgggatcacaggagcagatactgcgcccagtccttttatcaccttgttttaattttacttggttcataaattctttaatgtagaagaaaatgatgagaagcagtttttattactaaaggattcctgcctttgggattcacccataatttgtctaaataatgaacgtgttcacctttctgagatggaacttagctgctcaaactcaacttttcagagacaccacttgcaggtggtgtgggcttctatgaaaggacagcagccctttgttttgaaactccagatatggaatgtagaggcatttgggtgacatataaggcaggctgtttaacccagggccctcctccagatgggaagatcataattgaaggcataaacctatataaggcaaaagtgggagtagacagtaaaaccaaaaaacaaaacaaaacaaaacaaaacaaaccccaaaacaaacaaacagaaaaaccaaaaagtgaagatggccaaatggcgcctggagagaaagaacacaaactactcgggctgtacgtggacccagcagcgcaggacttaagcggcaggttcccaggaaggccggaggagggtgtccatgtggggagcgtgtgggtgaaagcgtgagggggagtgtgggggaaaggagcccaaatctgcggcttagctaacagtcatttcaaaaagcagttacaacgcctccacgcccctccagccccgcctggcccagcagagggctctcttcttcctcccatctctaagaccactgccggcgccgccccagaaccgcccacaagagcatggcctctgcacaaagtggtgaccccgcggccctcctctccccagcagctcatggtgtggtgggccaggctggcacctcctgtgcactgcaggagtcctctcagggtcagctctcctgatagcacacttgtgactcccgacgaaatggcccgaccagatgattcccgctgcaaactcacgacggatgagccccaccgtgcgcgcaaagcttcctgccggctttgcaccgcctagcaattcatgtgacaagcatcacagacatgggagaaaagtgttgtacaggaaacagagagacgctacccgcaagggggaaaagtggggctaggaaatccagacccggaagcgagcagaagaaaatgagacaagcctacagttaatatattcagaagcataagagaaggtactgccttcataaaagaaaaaaatataggctctaaaaaagggaatatgtatagaaacaagaagtctcagaaagtataatcatgacagcaggaatgaaaatttccgtagaggggttaaaatgtgaattgatatgatcttccagaaggtggaacaaaaagcagaaaagggaaagaagaaacactttttaaaaataataaattagacagtaagttgaatcctcaggatgcatgagtgaaatcccacgacaacagttgtgcatcaggcctacctaacaaggctggagcaaaatgctgagggcgccagagggatatcttgggaaaaaaaaaagaaaataaatgaaaagaaagtgaaggaaggaataaagaaaggaagaaatttataagttatctgatgtgaatcaacataatgggggaatatttgtacttctgaagaagaatttgggaaagttttagtaataggaatgcagaaaactaagcaaattaaagaaaaataggctgggcaccagtggctcacgtctgtaatcccagcactgtgggaggccaaggcgggaggatcctgagccctggagtttgagaccagcctgggcaacataataagacccttatctctactaaaaaatttaaaaaacaatcccacgagtttgaagttgcagtgagctgtgattgttctccaacctgggcaacagagctgagaccctgtctcaagaaaaaaaaaatgtaaagcaattattacactcagaaacatttaaaaaaatggaagaaagtagtatttaagtacactaaatagctcaactgagagctgttttgttcacatagtcactgtgaaaacattgagtattgcttgaacaaaaagataatacagtcttctagcagtgcctcaaatgttaaacctacatttaccatgctatctaggaattccagtcttaggtatacacccaaggaaaacaaaaactcatgtccacacaaaaacttgtacatgaatgtttgttgaagcattatacataatgaccaaaaaaatgaaaataattcaaatgtccatcaactgatgaatagataaataaaatgtcatatatccatacaatgaaatgttattcagcaataaaaaataaatgaaatattgagacatactacatcataaatgaaccttgaaaacagtatgcaaagttaaagaagccattcacaaaagatcacacattataaatgattcaatttatatgaaatgtatagaataggtaaatttattgagacaaagtagaccagtggttgccaggggctggaggagtacactaggggaataggaggtgacggctaaggggtatggggtttctttttagggtaagaaaaatgttctaaaattgattatggtgatggatacacaactctgtgaatacactaaaagccactgaagggtgtactttaaatgggtgaattaattgttatgggaattacatctccagaaacctgttttgttttttaaattaagacataaatattttgggaagatggaagtgccatggaaaagagttaatcttcattttcaatgagaggatgtcataatcaaaactgaaaaatcaggaaataatggcaaaagccaacatggaggcaagtacccaaataaacatctaaaattgttgcaagtagaagctttgggataatgagaattggagatgtggagaagtgggacaaggaattactgtttctttacaaactttatggaaatatttgatttttacttatacatgtataactttgataaaagtaaaaataataatataaatcatttggtccaactctctctctttgtaggtgagaaagcagaagtccaggaaataagtgacacaactagttatctgtcctagttcagaggacagcccctaattcctagccaaccaccttctatcaggccaatctgaatgacaaatttagatagcttcttacatagacagaaaattccttgggtgcactggagatgtttcctgacggagacaccttctctgagatgtgctccatggtaacagcagttggtatgatctttgtagcaagcttgattagggtatgaccctgggaacctggaaaagcccagcactttccagggtagacatccggctggaaagaaaacactgaattaatctcttaactagttatgtgaatccattcccacaatactggtcagctaatcactattgactgcagatctctcttatgcctatcaaataggaaaactcccaaggcacctctagtgtggttgttcttccagagcactgtatgcttatatcaatcagagccctttatcatatgagcatgttttctttcattgctctaactagactgtaagctgttataaggcagctagagggcatgagtggtggtgctggtaaggctagtgatggtggtagtgaggatgatgatggtgaccattgtgatcattgtggtgatgatggtggtaataatggtggcagtggaggtgacagtgatggtggtggtggtagtggtgatggtgattgcaatggtggtcatggcaatggtatcacctaaaaaggtggtggtagaggtaatggtgatggtagtaatggtagtggtggttgtagtgatggtgataattgaagtggtagtggtgatggtgattgcaatagtggtcatggcaatggtatcacctaaaaaggtggtggtagaggtaatggtgatggtagtaatggtagtggtggtgatagtgatggtgataattgaagtggtagtggtgatggtggtgatgaaggtagtggtggtggtggcagtgatggtggtggtggtggtgacagtgatagtggtggtggtgatgatgatggacatgggggtggtgatgaagaaagatggtgaggtggtggtggtggtggcagtgatggtggctgtggtggcagtgatggtggtggcggtgatggtgatggacatggaggttgtgatgaagaaagatggtgctggtggtggtgatgaagatgagggttttgatggagatgggggtggtggtggtggttatggtggtagagaagaaaaatgaggtctactactttgtagatataaactacagcctggaataagatcagtgggttttacccctgaaagttctaaatttgcaactaacttcaggtgtatggatcaaagttgagaggtgctctgctgtctattgatggctactgcctttagactgtaactgaaaagtttggtggggatcttacttggagatttctcctgttataattagacttaagaacatgtggtctgaatagcacttaacatagtacagtactggcacttaggagacaagtactttcaacaaatgtttgttgaatgactgaagttttcaatggaaaaggatggtcacagaatcaacttacagaaaagacatggaatgtatatgttttacttgaaaataaaataatctagtttactaatcttaaaatgataaataagtaaataattaatcatagtttactgaccataaaataagacataattcatgcagtgtactgactataaaaatataatgagatgatttcagattctgtgacaagttcagacactcttatattgcctccatttttaaaattaacattttcatgataaataataagaacaaaattctaaaatagaaataagtgattcttaatttagctttacctgaagaataatatctggaggcatttcatgatttaggaaacctatcccatgccagtacaattttgctttattatttttataactttctgaggtcccagcttcaatgatggaggctcctaaaattataaagtaagttgtaaaataaagaaacaacatacacaattcaaaacacatcatttgaattttaacaatgtctctagaaaattattactgggcaaattataagcgaggtaaaattcatactcaggaattgataggaaaagtatgacagttttcactaccactgaaattttgtcattttgaagaaaactagtttgttctgtttagtttcacaaaatgtatgattaaaaaaattgaattttgaggcaagtaaattagagatgagaatattatatggattctgtatcacctaaaaacgtatatagatctttatattttaacagctcatgtgataaatgagacttcctgtcattcccattcactcaataacaaaaaaagcagaaaaccaacaatgctccaaatgtccttcaagttacatttgtagcaattatgcagattcattgaactctattttaatcaaagaaatatgaaatatactcatcaaacattatcccttcaggttacttcattttagaagcaaaatgtattttatacagaataaataaagaaaatgcaaattgcttttacaaattgcatttgcataacacaccacaacactaaaaatacatgtgcctcatcaaatatctgattatccttactttttctttccttcttttttttttttttttttgagacggtgtctcactctgtcgccaggctggagtgcagtggtggaatcttggctcactgcaacctccgctgcctgggttcaagtgattctcctgcctcagcctcccaagtagctgggactacaggcgcccgccaccacgccggctaagtttttgtatttttagtagagacagggtttcaccatgttggccaggatggtctcgatctcttgacctagtgatgtacccacctcggcctcccaaagtgctgggattacaggcgtgagccaccgcgcccagctgattatctatacttttcctaagatgacacactttttgaaatagtaattgagttcctagagttgccagatttggcaaataaaaataaaagacagccatttaaatttgaatttcaggtaaacaaagaataatttttttagtagtagtcatgtcccatacaatatttgggatatatttatactaaaagattatttgctatttgtctgaaatttaaatttaactgggctcccttcattttatctggaaaccctatgtgtacttcgtttttgaaggctaattctgactgcccgctcactattcctactcgaccaactggctggacagaatctacactttcacctgctaatgtggggactgaataccccatccccataatcctttccagaaaaaaattaaaattttagtgtggtggaattttgaaaataattcatatttattcattttctcattcattaaaagatttaaatcagctttattaagatataattcacatcctatacaattcactcatttacagtgtatgattcagggttttgtattatattcttagagttgcacggccaccacaatcaattttagaacatttagtcaaccccaaaaggaacccatagtggttagctgtcattccccatttccctcaacctctctccccaagccttggcaattattaatctattttctgtccctgtagattacctattctggacatttcttttgctgctcccttgtagtcagtcacagtatgtagccttttcactaaggctactttcatttagccaatgcatttgagatttatgaatgttggaatgagtatcagaagttccttccttttattgactgcaggttgatattccactgtatgaatgcatccgttagtctttgttgatggacatggggttattctcaattttggtgatgatgaatacagttgctatagacattcttggcaagttttgatgtgaacatgtttcaatttatcttagataaatgtatagaagtgggattgctaggtcaataaggtgttatattgaacttcataagaaattgtcaaactttgccagagtggctgtgccatgttacattctcacccacagtgtatgagaggtccattttgttcatgcggttgccagcacttagtatggtcggttttgttttgtttggcattctaatcggtgtgtaatgatataacattgaggttttgacatttcactaatgaataattaatgtaaggcattttttcatatacttttttgacatgcatttatcttctttaatgaagtgtcttccaaaccttttgcctattttttatctggttgtctgtttgcttaattgaagcttgacagttttttataaattctggattcaagaatgtgtgtggtttccaaatattctcccctagcctgtaacttgtcttttcattctcgtaactgtttttttggcagagtagaaattaattttgttgaagcccatattatccattattttccttttacaatcatagtttttgatgttgtgtttaagaaaactttttctaactctaaaaaatttcgcttatttttttttctagctttaagctttatatttaagactgtgacccatttggggttaatttttatagattgtgggttttgggccaaggcttttttttatttttgcatatgaatgtccacctgttccagcaccactgacttgccttttttcctttttcaaaaatctattcaccacaggtgtgaactacttctagactttttgtattgttccattgatttcacgagtaccacatgctcttgattactgtaaacttatagtaagccttaaaattaggtagtgtgagttctccaactttgtctctttttttcccaaaacaaatttgactcttctagttccttcaccattccacatacattttgaaaatggttgtcaatttctacaaataatcctgctgggattttaattaggattatattaaatccatagaaaagttggacagtattgtcatcttaatggtattgagtcttctaatccataaacatggtatacttgtccatttatttaaatcttttttatttatttcattattgttttttagtttttagctctcagttcccacattttgttagtcttacacctaagtattttatgttttttactgcatttatgaatagagctgcttttaaatagtctctaattttctattattagtatatagaaattgtatatatacccttgaacttgtaaacctcacttactctggtagatttttttggtggtttttctacataagcaatcatgttgtctctgaatagagccatttttttcctttctaatttgcatgccttttcccctatcctctgcctttcgtactctctttctctcccagtttttcttcatttccctttcctgcctttttttaaatattagttgaaattttttatttattttttatttcttttgaaactgagtcttgctctggggcccaggctggagtgcaatgacgcaatctcagctcactgcaatttccgcctcgccttgcaggttcaagcgattctcctgcctcagcctcctgagtagcaggattacaggcgtgcgccaccgcgcctggctgttttgtatttttagtacagccggggtttcaccaggttggccaggctggtctcgaactcctgacctcaattgatccgcctgccttggcctcccaaagtgccaggattataggcgtgagccactgtgcctggcctccattttgatttctccattagcttttggatatctctgtatttttaagtaattgttctcatgattacaacgcacgtacctagcagctcatagtttatttgagttaactttttatcattcatataaaatctttacatttatagatgtccattaaatctcacccactgacttttcctttatggttgtcatagaattaaatctacatatattagccctccacgcccagacaatgccatacattttttcctttcaacagccatacatattttaaagtacttaaagaaagaaaattacctcatcttttgttgttgttgttgttttgagatggagtttcgctctcgtcacccaggctggagagcagtggcgtgatctccgctcactgcaacctccgcatcctgggttgaagctattctcctgcctcagcctccggagtagctggaattacaggcatgcgccaccacgccccgctaatgtttctatttttagtagagacaggatttcaccatgttggccaggctagtctggaactcctgacctcaggtgatccacccgcctcggcctcccaaagtgctggaattacaaggcatgagccactgtgccgggccacctcatctttactcacagatgaggctgttgctctttcttcattctttaagtcccgagtttctttttggtgtcatttctattgagctgaagaacttcctttagcagattcagtggcagataattttcttagtttttctccatctaaatgtcttcattttgccttcattcctgaaagatattttcactggatctacaattctgcattgctagatcctttccttcagcactttaaacatgtcgtttccttctcttctggtctctttaacttctggtaagaaatctgtaataatgtgtagtttttttttagcttctttcaagtattttcatctttgattttgagcaatttaactatgatgtgtctggatgtcattttccttgaatttatcttctttctgatttgccatgctttttgagtctgtaaatttatggttttttttttttaaatcgagtttgagatgtttttagctattacgtctttagatacattggtctcttcttcatctccctctgagactacaaggataagaatattatacctttttatagtgtcctataggtttctgaagttctgtttgcatttttttcaaacattttttcattctttgaattgcataatttcttttgatctatcttcaacttcactacttctttatttttaatttttaagttcggggtacatgtgcaggtttgttacacagaaaaacttgtgtcatggggatttgttgtacagattattttgtcacccaggtgttaagcctagtatccattagttatttttcctgatcctctcccttctctcaccctccatcctccaataggccccagtgtgtgttgttcccctctatgtgtttatgtgttctcatcatttagctcccacttataagtgagaacatgtgtttttggttttctattcctgtgttagtttgctaaggataatggcctccagctccatccatgtccctgcaaaggacatgatcttgttcttttttgtggctgcatagtattccatagtgtatatgtatgacattttctttatccagtctatcattgatcagcatttaggttggttccatgtcttttctgttttttttgttttttttttttttttttttgagacagagtctcgctctgttgcccaggctggagtgcagtgatgcaatcttggctcactgcaagctccgcctcccaggttcacaccattctcctgcctcagcctcctgagtagctgggactacaggtgcccgccaccacgcccagctaatttttctttgtatttttagtagagacagggtttcaccgcgttagccaggatggtctcgatctcctgaccttgtgatctgcccgcctcggcctcccaaagtgctgggattacaggcgtgagccaccgtgcctggccagttccatgtcttttctattgtgaatagtgctgcagtgaacacatgcatgcatatatctttataacacaacaatttacattcctctggatatcccagtaatgggtttgctggttcaaatggtatttttgtctttaggtctttgaggaatcactgtctttcacagtggttgaaataatttacactgccaccaacagtgtataaccattcctttttctccacaaccttgcctgtatctgttagtttttgactttttgataatagccattctgaatggtgtgagatggtatctcattgtggttttgatttgcatttctcttttttttttttttttttttttttttgagacggagtctcgctctgtcgcccaggctggagtgcagtggcgcgatctcggctcactgcaagctccgcctcccgggttcacgctattctcctgcctcagcctcccgagtagctgggaccacaggcgcccgcaccacgcccggctaattttttgtatttttagtagagatggggtttcaccgttttagccaggatggtctcgatctcctgacctcgtgatccacccgcctcggcctcccaaagtgctgggattacaggcgtgagccaccgcgcccggccttgatttgcatttctctaatgatcagtgacgtcgagatttttttcaaatgattcttggccacatgtgggtcttctttttaagtgtctgttcatgtcctttgcccactttttaatggggttgttttgttttcttgtaaatttgtgtaagttccttataaatgctggatattagaccattgttggttgcagagtttgcaaaaattcccttccattctgtaggttgtctgtttactccattgatagtttctttttctgtgcagcagctctttagtttaattagatcccgtttgccaattcttacttttgttgcaattgcttttgatgtctttgtcgtgatatctttgcccatgcctatgtcctgaatggtacatacaactttcaggctgagactatggggttttctaaatataggattatgttgtctgcaaacagggatagtttgacttcctctcttcctatttggatgcgctttatttctttcttttgcctaattgccctggccagaacttctaatactgtgttgaataggagtgacttcataggcaatacctaggttgtcttccagggttttctttttttttttgtagttttggcttttacatttaagtctatattccatttcaagttaatttttgtatatggtatatggaaggggtccaatttcagtcttctgcatatggctagccagttattccagcaccatttattgaataggaatactttctgcaatgtttgtttttgttagattggtagaagattagatagttgtaagtgtgtggccttatttctgggttctctattctgttccattggtctatgtgcctgtttttgtaccagtaccatgctgttttggttactgtagccctgtagtatagtttgaagttgggtaacatgatgcctccagctttgttctttttgcttaggattgcccttgctatttttggtttcatatgaattttaaaatagttttatctagttctgtgaagaaggtcaatggtagtttaataagaatagcattggatctataaattactttaggcagtatgggcattttagtgatattgattctttctatccatgagcatgagatgtttttccatttgtttatgtcatctctgatttctttaagcaatggtttatagttctttttgtagagatctttcacctccaaaattagctgtattcgtaggtattttattctttttgtggcaattgtgaatgggagttcgttactgatttggctcttggcttgacttttgttggtgtatagaatgctagtgatttttgcacattgattttgcatcctgagactttgctgaagttgtttatcagcttaagaagctttcgggctgagactatggggttttctagatataggattatgttgtctgcaaacagggatagtttgacttcctctcttcctatttggatgccctttatttatttctcttgcctgattgccctggagaggacttctaatactgtgttgaatatgagtgacttcactcctttttttctctgtttttgtttttctatcattaagcatatatagtcaatatttattttagatatcgtatttttcagttctaaaattccatctggttctttttattctcttggctgagaactggtatcttttcattcatttcaagtgtacttactttcacctcataaagcataattatgctagctgcttcaagtctttgtgtgacaattccaacatctgtgtcatgacggggttggcatctgttgtcttttcccttgggagttggtcttatttccgtaggagtttgcatgccaagtaattgtgatttgtaccctagacatactgaatattatactgtaagactctgagccctattactgtccactagggaatgcttttatttgcttcatcaatcaaccaagaaatgtcagtcctccttccttttatgagtggtggttccaatctcaattcagtcctcaaaacctttactacaggcctgtcatgtccatgtaccactcaggggttagtccaagacttgagccacagtttacatcattgccaaattctcaaagcctccactttgctgttttgggtctgttcccatgaatgggcagctgagaggtgaggccagaagctggccgcaaacagacaggggagcaggcgtcttctctgcagctttgccttccaggctttctgcccacactctctggcccacaggactactttattctgcgattttggctagaaaaattgggcttctttcacagatttagctgcctaccttgctgccacgtttgcagctctgtaattgctgcctgcctcagcctaggctgcaagagaaaagaaaagaaaaaaggaaactcccacaaggctcacatctgcagtttttggttcccctctaccaactgcctgctttgtttactttttagcccactcacgtagttgctttttgaattttgtccggattttttctcattgtaatcagttggaagagacttaacaggctttctctatcttggccaaaccagagctgacatttgtttccacatctatggctacagagaagcccgagcatttccttcttttcctcactctgcatgtgctactcttgcacctacattcgtcatcataggcttttcaaaatggaagttgtaaatacatcaattgatataaatgcatcaatacaaaaaagaaagcattaaaaaagtgtatcagaatgccaagaccaaaacaaacaaacaaccaaaaaatcccaactatggttcgtctcccatcttgtccccaacactcatgctttagggaatcaggtttgggaaagttctgccctctaactcactctctgaaaaacacatgctcacaagactgagtaatcatgctgttccaaatgctctccagttcatgcaagctggaaatttatttccctggcgtaaatttgactatcaattgattaaaattagcattactatgtgttttatatttccattctccttctgtccctttcttctttcctcccacattgttcactgaacacatattgtccatagactattataggcagggcatggtagataagattaaggttaatgattcatagccttaacccttaataattaattttaattggaagatattaggaacattatatataacctttaaacactgtcatttaatccctaataatgcatttagattggtgatcataagtaattttagtatataataatacaaaatgtcctaatattttgtgccttccacaacttcactgtggcatcttggctttcttggtggttcttttagatgcatgttaatgaagttgcacaggcttttttccctggaacatttgcactcagcaatcagtagtgacaactatttctactctcttctttattatctaaattgattaatttcccccccccaagttaccagataaatatgttttcctcataaacaaatgtagagaatagggacattcctgaagcattcttttttttttaatgttcctcttttcactttttctgtactcaccggccgacttcagggcataatcagccatctcgacttggtcttctctcaactttttaagtacataattgaccaagtttgacacttcctgtagaaattttataaacagttttctgttaacaatctttgccaactgcttgagttttgaccattcattttattgatttggacctaatttgcaaaattagaatagcagtgagcccctatcagctgcactctgagccaggccctgttcatggatctggactgacaccttcacagctcttgggagtgtcattttcaggaatacggtgtaaataaagccaaggtgtgttcagggactcccacaaggtcacacagcaccgtggacctagggtctcttctgaagccctaaccactggcatcacagtgctctcccggtgaggtgctgtgacctactgtgttctgtccctcattagtgtcctgtggttagcagtaaagacttgaacattctagagttatttgggaatcaaggcagtttacacagactacatgattgcttatattagacatttttcacccagtctaattaatattggattctgaaggctgctctcattctaaaaaacgaacaaacaaacaaaaccaaaagcaccctaagcaggcgtaacagttcaagttcaagctgcctaaacgtaacaccttcacagtgacaaggatgaaatggggtctggagggcggcaggtggtccatgtcagattgctgcgcatttcaaaaagtagacattagggaagaaaaagaaggtagtaatgacagcggaagagaaagaagcaaaatagagcttgtggtttccaacacagttttgcctgaatctgatgctgtctagactaactacattagctatgaagatgatgaatgcaaatcttttgctatttaaggtatttgtgtatagagctcagagactgttatttctttctttctttctttcttttactggaaaatagaacagttatttattttggtgtgaagtaagtcatatgcaatagaatgtcttctctgtgacacagcatttatgaaacactgggtttctgtacacaaaccaaatatcagtcaacactggacttcccactgggagaagaagcagatgtgacatcggaaggacatactcactccccgtcaccctggacatccgcgctaaccaccaccccaccctgcccaacccgcctagcctcatccaggacctctgtgtggtccgggtcctccacagggtctccatgggtgttccagttgtgattattgtccataccatccttcatatctcttagcaatgccttcaggacatctatttgttcgatcaaaaatagaatttgacgaaaattgttttccagattctggctttccttcctgtaaagggaaaatctcagcatgagaggaagaaagtgtaaagctcctgttatcagctgttgctgggctccacccgccatgtgatgaggtgctttatattgttgaagatatacattcttgagtgagggaagagcagagcatgcccatttctctaaagcatcacgcttcactaaaaaaaaaacaaggacatccaggggtcacatggctgagggtgtcctactgcttgaccgggctctgcatggggcaggcaaggctcaatcaatcttgctggtcccccagctgggtaacgtcacacaggtgaatcctaaatcccactgttacctttccaattgggaacaccttgcatttccggtgtagtacagagcagtggctttcgaattgtagcctgagttcagtggaagtgccttgggcaaggggtgctggtggatccagccagtgggcagtgactggttaccagtttgacagcctgagcatgcaagattttacttcccaagaatgttttttttttttttttgagatggagtctcactctgtcccccaggctggagtgcagtggcgtgatctcggctcactgcaacctccgcctcccgggttcaagtgattctcttgcctcagcctccccagcagctaggataacaggcacatgccaccgcgctcggctaatttttgtatttttagtagagacaaggtttcaccatgttgaccagactggtctcaaactcctgacctcaagtgatccacccgcctcggccacccaaagtgctgggattacaggcgtgagccaccacgcccggccaagaatgggttttctatgtttacagtttgaaaattactagtagagagaaaaagaaaatgtcaagcgaataggtatttctttatgctgaaaaagtataagcactacttatctggtatttttccccatttgtaaatcaatacatgtttgaattcgggaaaaaaccaagcatttagaagaaataaacactgttaaattttaatgactttctaccagtttttattccatgcaaaaaattggtaagaaaatagaaataatatttataattttgtgtctccactacacttccaaatcattaaaaactattttaaaattatttaaatggctttataattcttcatttcatgaatatattccaatgtatttaaccattggcctaattttcttatagggttattttccatttttagttatcataaatgacatggaaagcacacctcagtgtgtattttgtcaaggaatgctccatagaagtagaaatatgtaaaaggacaagtaattttctaaagtactacaaatgttactgtttggtgtttaaaattttaaattatgtatatgcacaagtgagaggaggcaatttttattttgttgtttccttcttttgataaatccaagtaacaataaatgtactatttttaatactaaatacagcatgggtagattaagtcacctctaaccctttaatcttttctatctcctttttttctttttcttcctcctttctttccatctgcatatatacatagagaaatgctaggaatgatatcattaaatattaataatagttatttctgggagtgaaattttgagttatttcagggagtaacttttctttcttatacttttctgtacgaaaacatttcagtatttgaaaccacaccaaaaagaggcatatagcaaaagatcgcactcactttaaaagttccagttgctctttaggcatacgaagtctggcctgaaaacaacagaaaaagataaatcattctgaattctgcttattcaaatagagtcttttttttttctcagaaaagggaaataaatagcacattgactcctgatatacagatgtgctggctggaactcaggagcgtcctctgagaggcccgcctctttcctagcctcacctgtacatcatgaatgtatttgaaggagatgaggtaatgcaaatctatttaatgagtgacattcaacaggagctcttggatgggcacatcatttcctatttcttaagactgtaaaggcctgaacacagtctgagagggaggttggaagaggaaaaaatagagggaagaggaagagagggaagggaagacaagcgggagaggcgcccctggtggatgtggaaaaacctaaggagcacatggcgacgttagaggaccatgctgagctctttgggcttgtccctgaataaggagggggactcccacttacaaataagaaagggatgtgattacttttgggctagattggcaatcacaatcagaaaattgcagaaatttatctaacactggtgtcatgtctggtatagatagtctctggtatggacggtcttggtggtgcccaaaccaagacaagaaaccaggaaaaggtaaagttactgtttggacacaacatgtggcttcagaggactttctgctatggaggtggtcagtgaaaacataaacactgggaagatagagcatgctggagtgcaggcagcactctggtctgcagtaccgggctactgtgctgcctgttcctcacctggaatgggggaatggcctagctgcatcctcctgtcactgagaagaacttgggtctgggtggccagcacctctatgtcccttagctcatcctgctgtgtgtcttccgggccctgccacagatgacggtggttgggtgctcacatttcaaatgccctacaagtcattagcctgggagcctccaaagccctgcactctcttcccgtctgtctttacccagcatgagacacacacacacaaacacacacactccacatacacatgcttatacacacgtatgcacatgctcataggcacacatgcatactcacatatgcacacatgcacagcccctattccaacatgggatggttggagaaggtcaataatattaccaacagagaaaggagggcaaaagagagcaccttggggcaccaatcttgaagggctcagaagccaacaactgagtggacaagctggtaagaaggggaggacaagtgtgaaagggtgatctcttccccagaggattccaggaaaaatagtcaacaatgcccatcgagggatggctcctgacatcctttctttacatctggaactcccctaccctgacatgttttactcaagtggtttatcaattaagaggcagtatctttgactatgtgccaagaaaataatgtagatcagagtggaggaatgatcaagtgtgaaaacgaaggccgacccaagcaatcaattcccttgggtttaaacttaaatcttggaggattcccgcagcagtctccagaaatttgtctcatccacatactctccctgccaggttgggaagcagacacctctgcctttaaggatcactttcttgtagcaacaaagctcacacttcaggcacccaacagagaactcaaagggaccctatgagtttcctggggctcttgacacacatgaccacaaacggggtggtttgaaacaatggaaatttattctgtcgctgttctggaggtcaaaagtgtaaggtcaacgtgtccacatgtttacactcctctgaaggtcctcagggagattctgtttcttgccttttctaacttctggtggctctgggcattcctaggcttgtggctgcatcactccagtctctgcctctgcctttacgtggtctcttcttctcctctctgtgtctctctcctctgtaagtctcctaaagagatccctgtcattgtatttaggacccatctgagtaatctaggacgatttgatctcaagaaacttaattacatctgcaaatacctttttcccaaataaaggtcacattcacagtttcttggggtcaggaggtagacatatctttttgggaatcacctttcaacctcctacagtgaccatcaatgtgctatctgggaaatagtgctccatctttacccagtaattagcttgcttttctgttacaaagactggctttttatcagttagctctgcccaaaatagtgctatactataaatgtgttgtgtcttgtgcgatgttattctgtcatgtgtgataatgatgtcagaatggaatgtagtgtggcacatagaaaaatattgccttgcttttgttctgaacaattacacttcttatacgttctcctcaacatttttattttgacaaggatgtgaatttgggagcttatcattggtagatagagattctcacttctagtttttcacattctgtttgagcaacttccctgtcagtaggagcagtgttttcaatttgtttcttttttctgttctagccttaaaataacatacagaaaatactcctcaattaatttgctgataaatgaacttgagagttccatgaaaaataaaatatttcacaattttaaaaacatttttattttgcttcattcccaaaagcatttcaggcaagttctactataggaacttgtatagtataagaacatgtaggacaaaacagtaagtaaggaagtgaaagtgaagataaaataaagattggaaaagtaagataatgcgagaaggatgaagttggaacctactcgtgcctgaaattcttgaaagttattagctgtgggctataaatttgtttcagagcatcacagcaaccaaatgggtgggagagggggcaggccaatggccaaaatttaccacatccacaatgtggaaaaagaaaatcaaaagtgttataaaggctgctttgtgtatagttgattatctttctgaaacatttctggcaatgagatgggggttcagtgtcctaggaaccttcctaaaacatccctccctgtaggctgttggcctcatgacaaagcctatgtcagggaaagcctcatcagatgtgaaaatgtccagagcactcgttaagaggacacagcctccagggatattgttttcagcaacaaagtccctgtgcctcatcctaaccatggattaaggtagggtttgtctgcatgtgctgtcaatttacagcctcctgagacacgaaggcgtcaggtagaggctggcaaagaaatagccatgggcaaagcccagttttacttgttttttgtttagtttttttttttttttcttcagataatgttgactgagacccaaagctttatgccttggaacatggctctagtaatttgaaccaagataaattcaatgatgtgttaacacatttctgacatggtcattaaaattttttttctcaatgaggtcccataagatatctaactttaaaccatataacttcaaggtgaatcctacaaactatagtgattgcagactgtgccctgggtaaataactaagcttgctgcttaatatagctttaagatagaaaccaattaaatattggagtaagtaatttgaagtcattggtcttgaactcacaactgtgatcactgtggcttgaatatctatgtttcttccaaaatttatgttgaaacttaatccccattgtggtggtgttaagaggtagggtcttttggggagtgattaagtcatgaaggtaccacccacgtgaataggattagtgcttttaataaaaagctcgaaggaagtagtttaggcccttttcgccctttgacctcctaccacgtgaagacacaagaaagctctcattaaacatagaatgcacatgccttgatcttggacttcacagcctccagaactgtgagaaagacatttctgttctttataagctacctagtctatggcattttgttatagcagcataaatggattaagactgtgctggtgatttgaaagtggcatgtgacaataaaattttgttctcagtgtagcagtgagcaaagtcttagtctgaatggcaggcccagtctcaacaaaatctggatcctcagggaggatcatttcagctctggaatatgcagtggtgtgaccacaggctgccttccttcattgtgctgatccattgtgctgatccagcttcctaatctataaatggatttagtaatactcttactgaaaagtcatttcgaggataaagtgtaatatatatttagtgttcttaggatctcttctgatgcataactattaccattatcctgttctccatggtggaatatgaggcgatatatccagctttttgaaaagtaatatcaaatcattgggattcaatatgacaacaaggtcacctaaaaattataaatattctttacttatttttcttttaagagtttatcctaagtaatcaaggagaggcaaattgattaagccataggatgtttgtgtttataatatttaaaaaattagagacaatccaattgtttagaaataagtattcattgaaaatattattcattggaatattttatcatccattacatgtcattataaaataatatctaaaggcaagggagcatatttaaaatctattactggctgagtgcagcgtttcatgcctgtaatcgcttgagctcaggagattgagaaacagcaactacttcatgtagcttgggatttataaagaactcacgtagaaataagttaaaatcagtctccagtggtttctgacagtgctcttgtctgtgtgaaaaccaggttaacactggtcaaaaattaaatgatcataggtcaacctcaacctcatgaaaaatactgtccttagaaacacggccatagtcattttattttatattttgagacagagtcttgctttatcactcaggctggagtgcagtggcacaagcacagctgactgcagcctcaacctcccaggctcaagtgatcctgccacctcagcctccagagtagctggtactacaggcatattccaccatgtctggctaattttttgatgttcaggctggtcttgaactcctggagccaagcgatctgcccacttcacctgcccaaagtgctgggattacaggaatgagccaccgtgttgggctggctagacatttttaaagggttgaatttgctgttgagtatgctggttagtctaaaatcggaaggtagaagggaaggatgccttttaaaaatgtgattagtctcagataacttatttatttattcattaatgtgcatatttattaagcctccatttacctggggactcttctaggctctagacaagctccttgatcattacattttagttaaaagggaagaaggcaagaagagagctggtaaagaaatcgatgagtgtctaaaataaagcaggggtaaaaactaggatgcacctacacctggatattgtcacaggtggtttgtgtggtcacagaagcctgtctaatgaggagacatttggactagctggaatttcagaaagaaaccaatcctgcaaagatctgcagcagaagactgtgggcaaaggggcacccaatattcaggcactaacagaacctgccagataaacttacaagtgtattagtcagggttctctagagaaatggaaccaagccaatgtatatatagagagagatttattttgaggaattggcttaaatgattgcaggggctaagtctgaagttttcagggcaggctggcaggctggagaaccagggaagggttgatgttacagctcgagtctgaaggctatttggagacaaaatttcttctttcttggggaatctcattctttattcttaagactttaaaatgcctgtgagaccaacccacattgtagagggtagtcttctgtatttagtctatagatttagatgttaatcacatctaaaaaataccttcactgcaatatctagactggtgcttgaccaaacatctgggcgccatggcctagccaaagtgacacacaaaattaaccatcacaacgaagcttaggcacaaattggcaatagttggagccaccatgaccactctgcgtgctcatctctgcttttctggttatgacctaactatccagcttcagctcccatgggcttggtcttagtctttgatgtgagaacctcgtggagtaggagctatctgaggctgaccctctctgtggggtttccaggtagctgtgcttttgtctaagactggggtctcacagattctcagcatatgcagactgagtagcgcctctgagatgggagttatcctgggcatcaacctatgaacctccagggaggcttcctcactggactggaatgctgtgggcatcatacatgtgcagtctcccctctcttttgggacttcacatggcaagacacattggaatgaggcagttactggaggaactaggaagtagaagatttcagaggccctgagcaaaaagggtatgaagtaggaatctgatcagtcaggcctaaggccactgactgggtcactgaagtcactatgggttaaaagatcagcatactggtggagacaggccaatatgtctgtccatcttcccccagagcagcagtaacctggtcatagctcctgctgaaaccacctttgcaaaaatgaaaactaagggaagtatgacggtgaaagagacaagacctatccgactccatcatgcttctaacttttaagctgtccttgttcattcctgggagtaggccaaactaactttgggaaggaattcagttcatggtttgactctgaaacaaaattgataacagtcctttcctgaaaagacccccttcttgcttggggaccaatctgcctttttaggactaacaaattagctacaagattagaaattacagtttaggggtcacgcagaccctggctccaagagtctgaacctccccaaattgttcctggggataacatcactattgtaagacctaagatcagtgcttgagatgttttgcagaccctgcactagatggatcagctgataccacccaggccagtaatctgactcaaccagttctgccagcccacccaggaacagaagacagcaagaaaacctcactttgactctctacgattccatctccaacctgaccaatcagcactccccacttcccaagcccctacctgccaaactatctttaaaaactctgatcctcaaatgctcagggacactaatttgagtaataataaaactccagtatcccacacatccggctctgcgtgaattattctttctccgttgcaattcccctgtcttgataaattggctctgtcaaggcaatgggcaaggtgaaccctttggatggttacactgccaccctcctccctccaatcttctgagtttctgagcatagaatggacaaggcttattctggaatgctgggggtggggtggatcagaaagaggacattcagtgactagcctcagtctaagcccacctagatctaactagcttcaggacaaagggaagtgccatactcctgtccagtgtcaggcagtgtcaggcagaagttggtgataaaggtttatttgccattttatttgtgcttgagattctcttggggaagtgtggagaatttttaggacctcatagctataaaactattgtcttagtctgttttctgttgctataacagaataccacagcctgggtaatttataaacaacagaagtttgtttggctcacagttctggatgcttggaaatctgagagcatggcactgccatgtgatgagggttctaccatggcagaagggtgaaagggcacaggaacatgtgagacagagagagaaatggggccaaactcatccttttattaggagcccactcttcaggtgactatcccactccaatgataatggcattaattcagagctcttatgacccaatcactttttaaaggtcttacctctgaacactgttacaatggcaattaaatttcagcatgaggtttggtggtcacattcaaaccacagaaaccacttaatagaattccatttcctacattaattttattagatattctcatataaaacaaagataacatattgaaagttgaactagccttgtagcatattaaactttaaatgagtgatatacaaaattacttaacaaaatatcacctgatatttataaagccttgaaccatattctgcaattatggcatataattgtctggatttctgaggaacatctgtttctttaagccactgatgatttaggagtcctgttaaagaaaagacaaactttgattaaagagtttctctggaaacataaaatattttacatgtattcataagaatttccctaaacatgaagaatatgtatactcttaagaatatcagatccttgggtgacatcatggaaaatggtggaatagtacacacaaaaaatcaggcctccatgtaaacaatatagctagtaaagattgacagaatcaattttttttggaactctggaatctaatccaaaacctacagcagccagataactaaggatagggtggctagtttctagaaacagagcatgtggcatttttctttacctgactaccatcttccatttctcaacctggtggtggcagctatagggacagcatttcacattcctttaatatagactttgttcttaaaataccatggtaatgttttttgactcatctagtggttccctgaggggctggcacagaagctgacctgtgtttattccacgcctatagctttctaggaagtggcaatatctattgaaagacttcaaagacatactgccgaagcccaactgggacaaaggacagtagatgatggaagtggcagacagacccaacagcccatgaataaagaggcagtctctttctggaaaaagggctcagaaggactgctgcatcatatactaggaagcagagaacgtaatgtgcatttctaggactggacgcatgttcataaatgaccccaagaagatactgggttgcacctctggtggatctgtagattgtgtataagcaggagatgaagactaaggcagagttttaggtggcctggcttagtcttgaaggagtgtcccagcttagagccaagctgcaaagactgagagagtaatctctgtctctgtctctgtttctgtctctctctcactctctctctggatccaggaattcaaggaaatatgtgagaaatcagtggctaaccactgagatagtggaatagcaaacatatacgacaagaaatacagtcttccaaaatagttttgggaggccgaggtgggtggatcacaaggtcaagagatcgagaccattctggccaacatggtgaaaccccgtctctactaaaagtacaaaaattagctgggcgtggtggtgctcacctgtggtcccagctactcgggaggctgaggcaggagaaatgcttgaacccaggaggtggaggttgcagtgagccaagatcgcaccactgcactccagcctggcgacagagtgagattccatcccaaaaaaaaaaaaaaagtttgaaaatgttactaaacaaacaagtgattgcagccctcaacatgcaacagcaggcaaaccctggggaagagggaaatctgaattctagagttattacattataatattaaaatgctcaatttgcaaaatcacatggcatacgatgaaacaggaaagtatggcacattcaaaaagagaaaatggcagaaaccatccctgaggaatctgacattggaattacgagacaaaaactttatatcagctgttctacatatgttcaaaaactaaaggaaaccatggacaaagaactacaggaaaccaggaagattatgtatggataaaatgagaatattgattaaaataaattatgaaagaaaccaaatataaactctgaagctgaaagaggaataactaaaatgaagaacttactagaagggctcaacagttgatttaagcaggcagatgaaagaatcagttaacttaaagatagagctatgaaattattgagtctgtgaacagaaagagaaaagtgaaaaagtgaacagagcccaagacacccatcagacaccatgaagtggatcaacatatgcattgtggcagtctcagaaagaggagagagagagaaaggggcagaaagaaatgaagaaataaataaaacctatgggatacagcaaaagcagtactaagagggaagattatagttgtaagtgcctatattgaaaaagaggaaaaacatcctataaatgatgtaatgatgtaccttaaagaaatagaaaagcaagagcaaaccaaccccaaaatgagtagaagaaaagaaataataaagatcagagaagaaataaataaaatggaaatgaagtaaacaatacaaaagatcaatggaacaaaggtttttagaaaaattaaatgaaactgacaaacctttagccagattaacaaaaaagagaagatacaaatgaaattagaaataataaagaagacatcaaaactggtactgcacaaatttaaaggatcattactagctactatgaacaactgtatgccaataaattggaaaatctagaagaaatggacaaattactagacacatacaacctaccaagactgaaccagaaagaaattcaaaacctgaacagaccaataaaaagtaatgagatcgaagccataataaaaaatctcccagtaaagaacagcccgggaccccatggcttcactgctgaattctatcacacatttaaagaagagctaataccaaccttatgcaaactattctgaaaaagagaggaggagggaatacttctaaactcattctacaaggccagtattaccttgatatgaaaaccagacaaagacacatcaaaaaaaaaaaaaaaaaaaaaaaagaaagaaagaaaactacaggccaatatctctaatgaatattgatgcaaaagcccttaacaaaataccagcaaactgaattccatgatacattagaaagatcattcatcatgactgagtgggatttatccctgggatgcaaggatggttcaacatatgcaaatcaatcaatgtgatacaccatatcaatagaatgaaagataaaaaccatgtaatggttttcaactgatgctgaaaaggcatttggataaaattcaacatctctccatgataaaaaccctaaaaaaaactgggtatagaaggaacatacctcaacgtaataaaagccatgaatgacagacagatccacagctggtatcacactgaatgggaacaaactgaaagcctttcctcaaagacctggaacacgacaaggttgctcactttcaccactgctattcaacatagtactggaagtcctagctagagcaaccagacaagagaaagaaataaaaggcatccaaactgcaatgaaagaagttaaattatccttgcttgctgataatatgattttatattaggaaaaaaactattagaactgataaattcagcagtgttgcaggatacaaagtcaatgtacaaaaatcagtagcatttctatatacaaacagtgaacaatctgaaaaattaataaagtaatctcatttacaatagccacaaacaaaatcaaatacctaggaattaaccaaagaagtgaaagatctctacaacgaaaactataaaacattgatgaaagaaattgaaggagaaacaaaaagtagatagctcatgttcatgaattagaagatcaatattgctaaatgtccatactacccaaagcaatctacatattcaatgcaatccctatcaaaataccaatgacattcttcacagaaatagaaaaaaacaaccctaaaatttatatggaaccacaaaagaccccaaatagtcaaagctattctaagcaaaaagaagaaaattggaggaatcacattacctgacttcaaattatactacagagcttagtaaccaaaacagcagggtactggcataaaaagtgagagataggctgatgaaacagaatagagaacccctacagagaactcattttcaacaaatgtgccaagaacatacgctggggaaatcatagtctcttcaataaatggtgctgggaaaactagatattcatatgcagaagaatgaaactagacccctatctcctgccatatacaaaaatcaaatcaaaatggattaaaggcttaaatctaagactttagactatgaaacaactataagaaaacattgggggacaatctccaggtcattggtctgggcaaaaatttcttgagcagcaccccacaagcacaggcaacaaaagtaaaaatggacaaatgggatcacagctaaaaagcttctgacagcaaaggatacaatcaacaaagtgaagagacaacccacagaatgggagaaaatatttacaaactacccatctgacaagggattaataagaagaatatataaggagctcaaacaactctacagagaaaaaaaaaaaaaacaaacctaaataatctgataaaaaaatgggccaaagattcaaataaacatctctcaaaagaagacacacaaatggcaaacaggcatatgaaaaggtgccagtttcattgattgtcagagaaatgaaaatcaacactacaatgatatgttatctcacctaagttaaaatggcttatacccaaaagataggcaataacaaatgctggagaggatgtggagagaggagaactctcatacactgttggtgggaatgtaaattagtacaaccactctgcaggatagtttggagaatcttcaaaaaatgataaacacagctgatatatgatccagcagtcctactgttgggcatatacccaagataaaggacatcagtatatcaaagagatatctgcgctcccatttgttgcagcattgttcacaatagctaagatttggaagcaacctaagtgtccatcagcagataaatggataaagaaaatgtacatattcacaatggtgtactatgcggccataaaaaagaatgagataatgtcatttgcaacaacatggatggaattggagatcattatgttcagtgaaataagccattcatagaaagacaaatatcacatgttctcaattatttgtgggagctaaaaattaaaagaattaaactaatgaacatagagagtaaaatgatgattaccagaagcaggtgagggtagtgtcgaagatggaggaggtgaggatggttaataggtacaaaaaatagaaagaataaataagacgtactatttgacaacacaatgggtgactacagtaaaaaattacttaattgtacattttaaaataactaaaagattgtatttggattgtttgcaacacaaaggataaatgcttgaggggatggataccccatccttcatgatatgattatttcacattgcatgcctgtatcaaaacatctcaggtaccccataagtatatatactatgtacccacaaaaaattaaaaaattttaaattttaaataagaaaaagaacatttgaagaaataatggctgaaaaagttccaaagttgataaaaagccatgaatctacacatccaagaaactcaacaaacttcaagtaagacaaacttaaaaagactcatgctgaaacctattataatcaaactgttgaaagacaaaaacacagagataatcttgaaagcagaaagagagcaatgccttgttatatagaagaaagtctttgttggattatcacctgatttttttcttcagaaactatagaggccagaagacagtgggatgacatatttaaagcgttgaaagaaaaaaaattctatatatgagaaaacgattctcccaactgcagaaaaaattaacatattctaagataaagaaaagctcatggtgtctctatgactagaccagcccttcaggaagtgctaaagggattccttcaggctgcagtgaaaggacattagagagtaactcaatgccgcatgaagcaatcaaaatctccagtaaaggtaacagagaggtaaatatgaaaccagtattattgttttgggtttgtaactccttcttttatttctttcataatttaaaagacaaatttataaagcataattataaatctatgtttatgggtacccaatgtgtaaagatgtaatttttgacaacataaagaggagtaaatcccagtgaatacagatcataaggaggaaaaaaaagaggagcagagctgaataggagcagagtatttgcattctattaaagttaatttggtataaatttaaactatattgttataaatgtagggtctcagttgaaatccccatggtaaccactaagaaaatatctaaaaaacgtatacaaaatgaaacagatcagaatcaaaagagtgcactacaacaaagcaattaaacacaaaagaaggcagtaaagaaggaaatgaagaacaaaaaaggtataagatatagattttctaaaaaatagaaaaatggcagaagtaagtcattccttagtagtaattaatgtaaatgaaaatggattaaactttccaatcaaaaggcagaggctggcagaatgaatttaaaaacatgattcaactatatgctgcttacaagagatttactttagaatcaaaactgaaatttataaaacatggctgaaagaaattaaagaagacctaaataaatggaaggacaacttgtgttcatgaattggaagatttactactgctaagatggcaacactacctaaagctgtccacagattcaaagtaatctttatcaaaatccaaacagcatgatactggataatgatagacatatagactaatgggctagaatatccagaaataaacccattcaactatagccaattcagtttttggaacagaggacaagacattcaaagattcctatagggaaagagtaatatttttagcaaatattactttggctttccacatgccaaaaaatgaagttggatcccttgcatcatatacaaaaatgaactcaaaatgggtcaattacctaaatattataagagctaaaaccagaaaactcttttaaaaaggtttggcaatggatgcttcaatatgacaccctcaaaattacaaaccttcgtgtatcaaagaaagtgcaaagacaacctagaatgaaagacaacctagaatgaaagaaatgttttcaagtgatatatctgagaaggatttggtatctagaatatattaaaaaactcttccaactcaacaacaaaaggacaaacaacctaatcaaaaatgagcaaaagactttaatggacatgtctccaaggaacacatacaaacggtcaataagcacataaaaagatgcttgacatcattagtcattagagaaatcaaaccatgatgaaacatgacttttcatccatcaggtggctgtaatttaaaaaaaaaggaaaaaaatgatagtggaaatgtagagaaattggacttcttgttttaatccatttgtgttgctgtaaaggaatatctgaggttgggtaatttataaagaaaagaggtttatttggctcacagttctataggctgtacaagaagcatggcaccagcatctacaactggtgagggtctccagctgcttccgctcatggtggaaggcaaaggaggagccagcatgtgcagagatcacatggtgagagagggagcaagagagagctgggagaagtcaggttctttttaacaattagctcccacaggaactaatagagtgacaactcattactgtaaggatggaaccaagtgattcatgaggaatctgtcctcatgacccaaatgccttccattaggcccccacctgcaacactggggttcaaatttcaacatgaggtttgggaggacagatatccaaactatagcagtcctcctacactgcttgtgggaatgtaaaatagtgcagccattgaggaaaacagtctggtggttcctccccagaaatctcattcctatgtatatacttgaaagaattgagaacaggtgttcaaataagcacacatacacacttatgcacagcatcactattcacaatagcctaaagataaaagcactctaaatgtccatgaatagataaatggataaacaaaatgaggtatatacatacaatgaaatattatttagctacaaaaaggaatgaggaactgacacatgataggatatggatgaaccttaaaaacattatgctaagtgaaagaaggcagataagaaagatcacatgctatatgatcttttttgtaacaataactgggttgaaacttttattttaatgggagatacatgccttaagttgtgaatatattaaagaacaattttccagtgtgctaggggtggtggatggtgatatttcccgatacgaaactacaaactgcacattctgcagtaatttatttgggaactgtgtgatgagcaagagtctctggttgtcaaaacctcccaagtggagtcacctaaatttagaaaaggtaaaatgtatgtttgcaataaatatattagaaattcttaactttaaagcaacatctatgactaaaaaatttgcaaaaagcaaaccacaattctaaaagaaaaatctcctttctaaattttctattaaaaagccagtattactcttacaatcagaaataaaaaacaaacgaaaaagctttgagaatgtgcaggtcacctccagcactttccgtggcatttatttacaaatatgagtcattccgttgagatctctctcaccaggcagacataacctgtggaatggttttaaggatcattacttaggaagacttacctacaagaagaaaagtcagtgtaagcattgtacttagaataatcttccatgatcgagttaccctaaaagaataaaaacaatgattagaaaaagaatttaacaacatcatgcatttaacttggactttagccactacactcacgtcaacaaacttacttattttcattcttgcttaatctaggttgagtctatgaattactttaatttccaatccactattttttaaattgagagaagatcgttttagtgatgatacacactcaccagcatatatgagtgcgcatacatagagtcatgcctcttactttcacatatgcaatgcttatgctagtatatgtctatttatattcttaaaatacttataagaaaaaaacaaaggcagttttctggaggtctcaaatgtagaactagctacaaaaaaagaaaaaaaagaaaaatcaggttctgattttatggaaattttgtactaagctaaagaactatgacagttaagaaatatctgataaaattctttaaagccaccatgaccttttttcctactctgtgttgaagtacagtatgctatacaaatacgatttgtgctcttttctgtataattgtacagaccagtgatgcctcacagaatgaacacatccatgaaacctcacccaggactggaaattgagcatactcagttctgtggactgaattgcaccccaccccccaacacacacacacacacacacacacacacacattcatttgttgaagccctaccatcattgttactgtatttagagatagggtctttaattgctaattaagggtaaaagaggttatgagtgggactctaaactagcaggattgttgtccttagaagaggtggaagagagaccagaactttttctctctttgtgcagtcagaagaaaggtcacatggggacacagtgagaaggcaatccaggaagagagccctcgctagagaccaaatcagctggaaccttggacttcccagcctccaaaactgttaaaaaaagtaaatttctgttgtttcagccacccagtctgtggtatttattattgcagcccgagcagatgaatataccaagcccatcagaagcccatcttatgcccttatcaaccctatacctcccacctccaaaggtacctgctctcctgagctctatccccattaagtaggtttgtctgggtttgaaccatctataaatggacccatgtgggtatgggctctatctgtctgcctcctgttcccagtcttaagtctgtgagagtcaactgtgctgttgtgtatagttgtggttcattcattcttataactgtgtagtatttcattgtgtgaatatatcatgtgggtatccatcctaacattgatgggtgtttggggctatgataaacaatgcagttataaatattactacaagcaatgcagctatgaacattcttgtacatggtttctgatgaagacaagtatgtatttcatttaagtgtattttcaagagagacattgatgggtcataggatacatgcataatccgttgcagtagattttgctcagtgttacaaagtggttgtaatgacaaccttttcacatctaaccttttaaaaagccctaaagggtggatggggagggaagctaaaatgatcacattaatctaacgtgaaggctataaacttccggataaagtattacaagttggcaaactaaaaatttctacttaaaacataagaaaaatcacattaagatggaccattcattaactgtattcactagagtgggccgcctaattctcccagtacagaatctttaagtagcttatctaccctacataaagcagtcatacctattagccatccaagagtgtgacagtgtggaaaccaactaagaagagaattttcttaactctcttcccctccagggaagtgtattctggaacctcttccttttaactattattggagatgtggagagtggtagggggtccactgtattaaaaaagttgttcataggtcagttatggtctacaagagctcttttggtgggctgcattaagtgaaaattatcacattaccatatttaccaaagattaactccagtgtttttcgttttttgtttttcactagaaaactggctgccaggctctgcattgcaaaattccttcggtgccttcacccagccagtgggattctgccatttggggcaagcatattttgttattactgtgattttgaaatgctgctctacttgtactaataactttgtagcattccttttatttttattgacagttttgttctgtgcaagtgcttcattgttaccaataggaaggttatttcattacttgtagtttttgttttcccagcaggcagcacatgggcagggcgtttgtaaataggtttagggtatttggattccctgctataataatccccacatatgttctcactagaggaaacagggtgattcactcaaaatgtgcatcccctaccagagtctttagtcaattatcacccaagaatgtaataaatgccactctgtgcccagagtcctgagcccggtgctaagctctgcataccaccaagactatacaagctagcccaatgacaaaaaaaaaaaaaaaaaaaaaaaaaaaaagtgaattatctggaagcttttaagttcctgctgctgtggctcattcttttaaagagggtggctctcctttcttaatccttctcccaagtctgctgttattaatccagataccgttgacatagaagtattgtgatcaagtgtaagactgtgatgaagagaaaccttcaaaggaaactattgaaaatgattttctctataaagggagaaaatactgtcgggtaacaggtaacagatgaacagacacaagtgacagatgtaacacataaaacctacaatttcaggcacaccgttctgccatgtttacctacccattcgcatcaggattttcgtcctctgataacaaagcattgccactggcgctaccgctggcgtcttcagagcaacgtctaaaaaacatggcagcccttcttgcctttgtttttccactcatgatcccctaccaaagaacaaacagctggtaggatgaagagcaacatttgtcctcattcctattttatgaaaaacatgaagctatacatacagtttctaaatttgttttgtataatgtcttcttcctccacgggtgtttcttcttgaagacggaattttgaaaagcttctgattcttctgttgcatcatcctccgtgacacctcataatgcagatggccaccacgcccagccagggcatggacaggcaaccacctctctgcttcaagggcctaattgtaccatatgtcacacccactgaataatacaaaggcccccccatgtacctaccgcttttcgatagcaaatctggatgttttgctgtgtttgcttcagtgcttttctaataaagaaaatatcagaaatataatagtagacccccaagtatccctgaatctcagcactcttattttccacagataactacaacctgaaaattgatatactctattctcattatttttgatactttactatgtaaatctgtatctataaataataccattttcatgcttaaaacataaactaaatgttatgccactctaggttttcttacaatattatttatcttgagacattaactccactcattttaattgctctatggtatttcattatacatacatcacaattcatttacccatccttctgtaaatgtatgcttaggttgttttcagtttttttggcaaggaataatgctcattgcacgttgttatatgcacatcacaaggtttttctaaacatacacctagaaacagaatagttaggtggaaggatgagctggtttatttggggcataaattctacgatgacagtcatttcactctcagcactttggagatactactccatggccttgtggattgattgttgttgatgagaattctgtcttatcttcatttctctgttttttttggcaatttctcgcgtagtttttaagattttctgtttatccatattttccagttgtattttagtgtatccaggtttgatactagtttttgtttttcctcacttataactcagagagtcttttcaatttgggtacttgtgtgttttttcagttctggactatttttcagccatcagggcttcaaatattgcttctctgccactgcctcaattttcttagaatggtccacctattgacacttgtgtctcccttttgctttccgttcaactgctccttcatatttgtttttgcttttttctctttttacttatgctgatttctgggtgaatttgtaagtgttatttttcaatttactacttattttctgaaagcttagatttataccaagaaacccccaagtttctacttttttacctactagtccaaaattcgaaagttacaaaatggtacacagcaaatatggcctttccacccggcatctgccttctagctattggttcccctctcttttagcatctatgctaccatttatagtatttcctttcaaagatgtgatacacatgcacagtatgtgacattgtattatatatgtaatattttataggtatatttatctctccacattcctaatggtagcttactataaactgtgctctgcatcttgcttctttcccttaaacatgtatcttggaagttgttttgattgtttgagataatcttcctcatttatttatgactgaatagtgtttcattgggtgaatgggccataggctatttagcctgtctcatattgatgggcagtttggtatttaaaataatgtgcaatagtaatcttgtatttaagttattatccatatgtgtgaatatatctttaaggatatatacccagaggaggaacttctgggtcaaagtctatgtgtatttttcaagaataaatccgcacatatacagccaactaatcattgataagtttgtcaggtgtacacaataaggaaaggacactgtagtctcttcaatgaatggtgctgggaaaagtagatattcacatgcaaaagaattaaattggacagttatcttacaccatacccaaataataccttgaaatagataaaagacttaaacataagacctctaaccataaaattcctagaagaaaacaaggaaaaaatctccctgacattggtcttgacaatgactttttaaatatgacatcaaaagcacatgcaaaaataaataagtggaaccacatcaaaccaaaaaccaaaaagcttttgcacagcaaaggaacttaataacaagaaaacaaataactgaatttaaaagttggcaaaggtcctaaatagacatttttttccagagaagacatacacattgccaacaggcatgtgaaaagctactcaacatcattaatcatcagggaaatgtaaatcaaaacaacaatgagatatcacctcacagctgttaggatggctattataaaaaagataaacagctagtgttgcacaaagtggtacacgcctgtaatcccagctactcgggatgctgaggcaggaggactgcttgagcccaggagtttgagaccagcctgggcaacatagccagaccccatattttaaagaaattgttaatcttaaaacaaacaaacaaaaatatataaagataagtgtaggcaagaatgcagagaaaatgtaacccttgtatactgttggtgggatgtaaattggtatactcattatgaaaaacagtatggaagtgccttaaaaaattaaaaatagaactaccttatgattcagcaatcccacttctgggtatatatatccaaaggaaataaaatcagtgtgttgaagagatatttgcacttccatgttcattgtatcactatttacaagccaagatataaaaacaacccaagtgtttattgatggatgaatgaatgtgatttatgcacacacacacacacacacacacacacacacacacacggtgggtgtgtggtggtggtggggggagagaaagagaatggaatattattcagccataaaaagtaggaaattgtgtcatttgtgtccacatgaatgagcctggagaacattatgctaagtgaaataaaccagacacagataggtgaatactgtatgatctaatttatatgtggagcctaaaaagtcaaatgtgtagaagcaaagagtagaatgggagttgccagtggctgatgggcagagggagtgggaatggggagatgttggtcaaaaggtgcagagcttcagttacaagaggaatacattccagggatcgaatgtacagcatgctgactacagttagcaacattgtattgtatacttgaaatgtattgagggagtagatagatctcaagtgttcttaccccacatacgcatacacaaaggtaactaagtgagatgatgaatatgtcaattagcttgattgtagtaattatttcacaacgtacatgtgtataaaaccaacatgtacaactgaaacatagaagttttgtttgttaattatatctcaataaagttggaaaaaatccaaaatgtgtctttaaaaatttcaaccaaagaaaaaggccattattttaacatgcagagcactgcagagtcaaagaaatccagtctctctcctgtgtgaagagaagatgatcttgtttctccaatgaggctgaaaacccaaactgctataacattgaaatacataaatatatatcaaaaaaggaaaccttgtctttaaattactcagattatcagaaaaaagcacaaaatgtaaaagcccctccagttggtggaaccctggtgagactatgttgtatgttctagagggaaagactgagctcacagaggtgaaggttggagaggggaattatacaagggctttcagctgcttgagattggaacagacagtaacaaggcagggcaaaagtgggagagatggaaaagcacaaatggaggatgtgtcctgaaagtttaaataaactagcttcagccaacaacatgggtaaaccaacagagaccaggcaggaaggaagggccagagggctttgaaaaatcagaatttgtactcaaatacatttttcctcttctcaaaatgctcataagcaggagattatctgcatatctacaagtaaagtgaaaaaattaggcataaagtgaaaatatatgtcagagaatgttggatctttctaaatactgaggccgattatgtggtagaaagatgattatgtcataaagtatagaaaataaaaacattgagatattcttattataaataaattattcttgtatcatgttttaatttccatggcatcattacctacattcttgtctgatctggtttgcaaatatttgtaatttcaatcacactgcaaaagtcaaaagttggctaggtgtggtggctcatgcctagagccccagtgctttgggaggctgaggcaggaacattccttgaggccaggagttggagaccagcctgggcaacatagcaagaccattgtctctaaaaaaaatttaaaaattagctagatgtggtgctgtgggcctggactcctaattactcaggaagctaaggtgggaggatctcctgagcttaagagttcaaagcttcgctgagccatgatcacactaatgcctttcagcctggatgacagagcaatatcctgtctcaaaaaaaataaaataaaaataaaataaaaagtttcttctaaggaatgataacacttcattatcactgaacttatgatttcagccagtcaagaaggttatcaacttggatgaatgctgtacttttttgttaatccaatggagaatagagatgctctttggtcatgacagctccagttattatgatcaattaaaaaaaaaagaataaccttcttgactaggcacggtggcccatgcctgtaatcccagcactttgtgaggccgaggcaggtggatcacgaggtcaggagtatgagaccagcctggccaacatggcaaaaccccatgtgtactaaaaatacaaaaattagccaggcgtggtagcacgtgcctgtaatcccagctacaccggaggctgagacaggagaattgcttgaacccaggaggtggaggtggcagtgagccaagatcaccccactgcactccagcctgggcgacagagcaagagcaaggctctgtctctaaataaataaataaacttctcttgaccatacaatcccgtagctagaggatgctgtgacttgcacaaacaaaagcatttgtcatgcttggcaataacctaagagcgtgtatatgcagtggaacaaacatttgacattgcagtatgaagtcttgattactcatgactggaccactgaagatgcttagaattcattatgatattatattagagcaggataaaccacagaattagagttaattcctgcacaaaaactatcttctctttaaccaattctgatattacctgtctcctgctagatttctaaggctatactcgtgtaacagaaacagactcatgttcagttcaagttgtcaaatacccaccattatgaaaagtcttgatttaaaaaaaaattttcaacaagagaaaaccaaggctgctaactgttgctgcagtcgttggaacaacaggatttctttgaatgttctctgtatcaacttatcccctcaaactctcacaagcggttaccaccgggtaagtagcccttattatttttgccagggttgtatagggctttctgggtatcaaaagtgtctcctactgaactgcgccatagctgttggtgtctattggcctcaccaagcatatgccagatagataatcttcattcccatgaagcaccattggtaatatactcattgtactttctgtagatctcaaaatccaggcaggcaacaagtttacacttaagccaagtgtttggagttctaaacgcgattccatataaatatggttaagagctttaaaaaaagtctctcaacttataaaacagaaatattctcaaaaaataagatataaggaagaatgttcacatgataattttattatcgacacacaatttccaaatacttattagtcttgaaaaaaatgcattagatgagaaatttgcaagcaaatttgtctaaaattaaggattcctttactaagtgaatcattactcctgcatctcattagtaaattctttttatgttttatttttgtatactggtggggtgttttgttttgttgtgtttttagggtgagacagttatacttatttggaaaacgtgatgcatgtccccaatttttctggaccgctctacagtaactgtggttcccagccagagcggcatgaggaggactgaggcctgactctcttcctgcgtccacgtccccacgtccccacgcccccacacccctgcaacagtaaggccctgctcccacccccgctgcgtcccgcccggttccccgtggcatcgctgcgctgccctgccctggtccggctctgggctacgggcagttgacaggcggcgcccgcgctccgcttcctgccctgattggcccaccgctccccctcaggcttcccctattggctgacagtgctccagccgcgcccgccggttggccgttcagccgttgccctggcgacgccgatgttgtggttccgcggcgcgctgggagtttgggtttggttggctgcagccagccagccgtgtaaaaactccaacgccgggcgccgcgggcagcacccacggagacccgcggggagctggtgagcctgagcgggctggaggacaatgggggcgcccactgtggtcccgggccttgtccactgtgcggagctcgcagtgcgggcagtgcgcgccggggctggagggaggggaccaccttgtcgccgggttgggatgagcacagggcgggatctccaagcctgcccaagtcccgcggccccttggttacctgttgcttatcctctctgtacttgctgtgtccctggcgtggacgtgcctgtactggatacccggcgtgacgtgccccctctgtgtgccccgcacgcacgtgtctctgctgaataccccgcgtgaatgtgcccctgctgtgtacccggagtgcgtacgtccctgctgtgtaccctgtgtggacgtgccctgctgtctacccggcgtgcgtgtgttcctgctgtataccggcgtgatgtgctcccttctgtttacctggcgtggacatgccccctgctgtataccctgcatggaagtgccagcgctaggcgatcgtaaggcgcctgcaggcgtgtcagggcgaggcgtacagaccgacccagagcgggcgcgcggattttgcttttgcagctgcagctcctggcaactggtcaagcaggcagcgtccagcgcacccgcgaacaccaggtccggcagcatctgtcttttcccgcagcgtgcagcgcctgaccatgaggaacacaagcaaggaacttcagggcgccacgcaccgctacgctccctgcggtgagtgcgccctgagcgcgtcccggccagaaagagctgggtgcgtgcactctgcttgctagacacgctgtggacccaacgtcctctatgtgggctggaggggggtgtgaacgatggaggaccaagtgataaaactaacaagtcaaagaaagccacaaactgctcctgtgcctgagtgtgaaatcaagacttaaatatgagtggggggagtcttgtttttctttattttcaacaagagagaaccaaggctacctatcttggttcaatctggagcaacaggatcccttggaaattttctttgtcatagttcaaccctatacaattctcacaactgcgttcctgaatgttgacctgggaagtttcttctctagcagaatcccctaggaatttcactgaatccctagcccttgctcctactttagaccccaagcaagttaaatatacattctgggtttagtgtctggatacaggaaaaggaattcagtgaggttcatgtcttcttatgtgccagggtttgaagtggaggagaggggaaggaagaagaagtcttgagatgctgtcttctgggttttttttttttccttttgctattgcttttttatttgtgaaaggctgtaggagggtagagaagagggtcctggggatcagctgggacagctgagttgcagctggtcggcaccctggagccagcacatttgctcagaagtgaaccaaatgtgacccttcttcatactctaaacatgctgctagcccagagctctaccttgtgaccactattgaagatagtgtggccatgctggggattggaaaggggacagcacagaaggcctggctgatttgccttttcccagtaggctctggagcctttatgtgacttctgggtgccttctagtgaccttgtctgtatgaacagcagtaaggaacactaacaactgccaggcactgttctaagtgctttgtattaatatacactaactcatttaacctcataacaatgctacaaggtaacattacccccattttatagagtttggagtaatttgcccaaggtcacacacttcgtaagtggctccacagctgttctgtgaggccacagcagcctaaagcaggagcctgtgcccctgcgggtatgtgaacatataacacactgccttgtgccttagagaccagaagagctgggggatcttcagttcatctcatagactgtcacagactgtgtttcctcactgattaaataagagtactaatatatggcaaatgagaaggcagggaaggctatatatatatataaaaaatctataggatagtaaatgactgatattgtacaagtgccaacaattttttgcatgataaaagctgagataactcttagtccctttaaccctctgtgtgtgtgtgtgtgtgtgcgcgcgcgtgcgtgtgtgtgaggtggtcacaaatggttcttactgatccaggccctcattctctgagtgcctcctttgtatgcatttacaaatggccaaccagattcgagttcagtgcctgtccacagcttccagtaatgagaagaaggtagaagacacactgttctctgtggattaattagtaatcaaaacacagagcggaaaaataatgcaacaatcaaacgccttctctcaaatagaaaatatttgaactgaatatgatcggagtatgaagctgctaaattctcttattcattcttaaattgattctctgtgatcttttgtgcaattctttaaatcttttccaatttttttctttccttttcgaaaccatatagtgttgattcagctatttaatgtcttttacatacttaaaagattgtctgtattaaataccatccattaaaaattcaatgtctaagcttttagctttaaaggatggttacttctcatttctctgtgcttacataaatcaatttattcagtactattttcctgtgcatctactgtaatagtcagcattctccaaaccaaaataaccaacagcatatccatgtctatctttctatatacatatagatagatagatagatagatagatagatagatagaaagggagagagagatttgttttaaggaattggctcacgtaattgtggagtctggaaggttcgaaatttgcagtgcagaccagcaggctggagacccagggaagagctgatgttgcagtttgagtttcagagtggtctggaggaagaatttcctctttctgggggatctcattcttttctcttaagactttcaattaactgcccacaaaaagagtcaaactctgtaaaatatttaaagaggtttattctaagccaaatatgagtgaccaaggcctgtgacacagccccaggagttcttgagaatatgtgcccaagatggttgagtcacagcatgattttatacattttggggggacagaagttataggaagacatcaatcaatacatgtaaggtatacattgattcagtttgaaaaggtgggataactccaagtatgtgtgtgtatgtgggtggggggtggttccaggtcataggtggatttaaaggttttctgattggtaattggttgcaagttattatccaaagacacggaatcgatagaaaggagtgactgggttaagataaggggttgtggagactaaggtttttgtcatgcagatgaagtctccaggtagccaacttcagagagagtagatgtgaacatctcttatcagacctaaaaaagtgtcagactcagttaattctctcctggatcaggaaaagagctggaaaaggaaggggattctctacagaatgtagattttccccacaagagacagctttgtaggaccatttcgaactatgtcaaagaagtctatattggggtaaaatatttcaatttctttcaggacctgctatctgtcatgtgatgctatactagagtcaggttgcaatttggtctctgactgccacagagagtctgttttttcagtcttaagatctctgttttaatgataatgctggtctgctgtgcctgaattccaaaggaaggagggtataaggaggcacgtccagctttccttcccattatggcctgaactaatttttcaggtttactttggaatgctcttggctgagtggggggattcattcagtcagctggcgggtggtggggggcttagaagtttatttttggtttactctgataggaggaagcccacccacattatagaggacagtctacttcactcaaattctaccgtttttaatgttattttcatctaaaaaacttcatagacacagctaaaataatgctttaccaatatctgagtaccatggtccagccaagttgacacataaaattagacattatacctacccaagaagaggatattgtgttagactctgaacatactgcccctgtgacagtacgttctgataagtggtattgaatagaaggggatattgtgttagactctgaacatactgcccctgtgacagtacgttctgataagtggtattgaatacacccagtcacttgtgtcacattaattgcatcttttgtatctgacattcttcctgggttttgtttctaaagttttcaatcaggtgtggttttttttttcttacatttgggcatctggttaatcaatttcagattcaaatagttacctagaacctcagttgtctgagtgccccagatctcttctctctgtgggggtcatcaataaacactgataactccaggtccctgggattttgccaactcacttgacagaaactcccagtaggactccagggagtctcctgggtggtcccaagccagcctgcagggcctgtcctggataccctcagctcaaggccttagggagcctcatggcttcaccaggcccatgttcagctcctctgtccacagcacctttctgcatgggctccaatcaagaagggaggatggacagagaaccgctctcttcctccactcgattgtgcctggcttcttcgtgggacctttttcaatagaaatcacacaatctacactcactgtgtttcaacttgatctttctcaagggagccacacccagtcacctcaggaatctctgaatttccagctgagatgtttttccataacacataagtcacctgtttccgccacttttcaggaaccatctagacctctggccacctttcacagccctctttggcctcaggcatgagcaaagccattatgattgaaaacagtaattacatattaataataatgaaagggacaaggagagagggagagggagagtgataaggtgagatgaattctcatgtggggagtctgggtggagagaatgggggaactcacactgtactcgctcatatggagagaggctgccgagctgattcgagtgccattgctcggtggacaggcctctttgaccactccccagtcctacctcttctcactcttgtgttattggtaaatgtgttcaaacaggctgttatttctgtgacagaacttagatttcagtatttttaacatactaaatttagcaaatcttggtcaacatttagtcatgtattccacaggcttacccataacgttttaagtgatttgggatttttcaggaatgtatattccccaacataaccagaaatactgttgtcttatttttatggaggattaggagagagagacagagacatcatggggcttgggtacctccctgggaagcgaaagcacccatgaaagaggctgagccctagcagctttccccttgattggtgccagtggtggcatcttggtgggcagtagagactggattgcatagctggtgttatgactcacgtcagtaacccaaaagagggcattttcttccttgctaatgggctctgtggcttgcactgccccacctgatggtgttgtctgcatagagatactctggtagaggcctagaggccaccccgacacacagcaacagtgtggccctccgcctctctcctctatagattggtattaccacgtcccagtgaagcgctctgagaaggccgtggatgccccaccagcgtcccagatcccaggtctcagcaatttgggagactcacacagcgagaacctgcctgggactcggagatactggataaaagaaacagattcggaatatgtgaagctcgcgaaacaaggtggcaggcccggtgagccccctcctgccctgttcagtgtggcagcctcgcgggcggtgaggggggcgtttgttcctaatttcttccatataaaaatattactacagagtctgtatgtttagcttagggccttgggaaagctaggttaattaggtgtagggatgagcatgatctccagggatgagctaatttttatgatgctagaataaataggccaaattcacagaatttcctgtgtaggatatttcttctgagtaatgcctttgcgatgattcaacccttccctcacccactttatattctaattacaaagagaatctcaggaagttgcctccaagagagaatctgtctttgcatgctaccaattcttgtctaattgtgaaaaggttttgttgtttattctcattgcggcttgtcctttgtatgaaaacgttttagaaaatgaagaccatagaggagtttcagtgtgatactgacgaggaccaaattttgatacatgatttaattgagaaagtactgcttaactatgctaaaaactaagttatttgagctcaatagaaattactgatcagagtctaaaatgtctcagagccagccttgtggtcagtgacttggagagacactaaccttttttcccctttagctgccattacccctgtggggattgtcagagagaaaatgggaagcaaaatggcaacatctttgctttaatattaaaaagcctggaccaaacaatttgatggactaggtgtgatgctcagagaacaagacctagacattttttcttagattcacctcctcctgctgttggttaaaagaacattaaggggacaaactctgaatgtctgtaaatcagataaaagaattgcatcaatagtagtttcctgagtgtgatcattgtgccatgattatgtcaggaatgtcttttggcagcatctgctgaggtatagggggaggactgggcattgtgtctgcaacgcgctgcccagtgattctgaaaacaataacgacaataaaaataataatgagagagagggacagacaaagagagaaaacataaagcaaatgtggtagaatattgtttggggagcctaggtcagggtataggggaactcatactattcttgcaatgtttctgtaagtctgaaacatttaacaatgaaaagtgctttaaaagtaaaaaaaaaaaaagaaaagttaaaattttcttactgatagtaataggtcaaccaaagttgtctgctactgccacaggcactgctatcattttgctgtccttatgatcaagaaagtcagttcttcccactccccgccttttgaaaccgggggagggaagtgtggggagctagaaagcaagtgggtgagtccggagctggcctgggcctctgagaaggagcctgtgctctctgtgcctctcagggttggctccaaggtgactgtgaaatctcccaggtacctttcaggggcttgtatcctacttcccatctggaaacctggaggtgtggcttctcctggaaatggtaggggtggggttagggacagctccacagtggcagaggacagtcagaccgtcctatgctaggagaacggtgtgggggtagctgaggatgagggagccagcatgtgcagcccctggagacctgagcagtggagggatgggccccctccaggagctggtagatgctggcctgcatagatgcagctcaagaccaggagctctgtccagatctgcaaagagtgagatgtggggaggcatacaggatgtccctgcctgagcacaaagcaggacgcccacctgtcagcctgtgcacagacaggtgaggatcagggatgctctgttagtccctggatcccagaggcaactacagggagacctacagttcgccttgtaaattgagcctatcactggcaatgctgtgcgtctgtgtaggggcggcggggtgtctcacagccatgtcattttctcttttgagatttgttgaagcactttgcccctggaaccaggaaaggctctccagtggcctactccctgccagactggtatatccaccacagcaagccaccgacagccagccagcaagagtaagtaccttaaagcactcacatttttgtttatctttacaggaaaaaaatagcccaattttaattttaaaaatacaaatgtctaatagtggtagcaagcatgtgatatgacaacttcaggttctcttttacaatagcctgctctttgagggatgtagcctaagttgtcagaaaaccagagttctggaaacctgtggcattttgtgccaccctagagtcttgtgtctttgggctccttctcggtaaattgcactgtagtgttaccggcgggtcttcgttcttagagcttctaagatggtggcgggctgcttccaagatggtggtgggctgctctcaagatggtggcaagccttttgttctctgacctggggttcttggcctcacggattccaaggaatggaaccttgggccatgcatgagtgttatagctctatgagaagctgtgggtcacggaagagaaccgtggaacccagcgactagtgttcggctccattaggacgaacccgggcacttagctgcgcaggaacaatggcgagcctctagcccgatggggagcgtcagtgggtgcctccctggatcagaagtgcagcggacactctgccggatccggagaggtggaaattagcggcgggtctgcaacggaggcaatcagcagtggtggactgtgagtgaaagctcagctcaagccggaacaaacacagaccagaagagtgtgcagttgcgagatttaatagagtgaaaacagagctcccatacaatgggaggggacccaaaggggtttgccactgccggctcaaatgcctgggtttatatgccgatcattgtccctccccctttgctctcaggcaatagatgattgactatttctttacctcccgcttttagcctaattggtattttagtgaacgctctttactacctgattggtcgggtgtgagctgagttacaagccccatgtttaaaggtgggtgcggtcgccttccccacctaggcttaggaattcttagctggcctaggaaatccagctagtcctgtctctcagtaggactgaccacatcctcctgatgtagaaatagcagcctatcccaaagggttctcattaaagacaaaaggcactaggtaaagctagaaatacatgaaatcctaaatttctatgttcaatattgagatatggggagccatcgttcccataatatttgaaatgtctaagaaatttctatttgtggacatgcaaactttatctccagaaccacctgtcgtggattgagaggtaaaatgaaaaatcatttcaggccatttccccatttttttggcttgaaaataggactaccacaaatatatttccaagtggttatccggtgttacttgaatgttctgcacactgccacatggactttttcttcccttccttctgctttttttcttccagactgttggtacccctgtccctttgctgtctcctcccaccccatatgtccttaccaattgtccaagccttctaggatgatctacttctggggccttcagtgttttccgtcctcctgggaccttgtcctcctctggaccgcagaccacctgctccaggtcctgggacaggcagaggatgaagagtgggaagctcaggagaaatccttccttcactgaaaatctgggaacccaggagctataacttaacatgctttttgtttttaattgtccctccctttgttgttttcaatgctcatctgtttctgtgggctttttcctgccgagaccacatcagaagtgggaggcctggggagaggtgccgcttttcacacctgtgctccctgagcagctcagccacactcatggcttctcttactgggtatctgcgtccaccttccaagcctgcatttccagcctctgaccgctgctctctggcctcttcactcgctctctcggaggcccccagccacctccttcaggtgctttgctgcagtggtgcccagtaccccacgcctcgaccttgcccttggtgcccactttgcagctggggccttttttcagcatcctggagccctgaacaagtacaaatgaggagcaggacatgggggcatccctgcagcccctcagacactgcatggggggtttgtgttgccgtgtcaaacttgaatccagtgttcttccctgttcaaacctggttatgtgtacagatggtaccttcagggatctgaaggctgaagcattctagtgcctttggatgcccctcctgtgtgcgctgcctatatgggaagactggttgctagtttaaatactcacattaaaaatgaccatccaacaggaaacagagcatgttattattattttaaatgaacatgttaaatggtaaatgtttaggggtgtttagctattttaaggggtcaaagtggtagatgctatcctaaaagaaataattattttataaggtacgttttataaattcatattttagtatatctcgttttactaacgttgagaccttgtgatttctaagtgggcctcctgatcctgggacgcagggcctggaggggttggtgtgttgtttagcaggcacaggagggaagggcccgtctgtgttttcaaggagaatgggtagtgctgatgtcaagagagacggaagagaagagaataagggagggagagaaagagaaagagagggaaagaagaggaagaggaaaagagagaaagagagagagcaggagagggagagagagggagagagagaggagaaaggaaaggagggagacagtgagagaaggagggagacagaaggagggagggaaagggagagccagcgatggagatggaaggaagggagggagtggaaatggctctgagcaccaggctgtaactggtgtctgtccttgcagagtgcgggctgtctccatgccggattacatggttcatgaagaatttaaccccgatcaagccaatggtagctatgcatccagaagagggcccttcgacttcgacatgaaaacagtttggcaaagagaggctgaggaacttgaaaaggagaaaaaaaaggtgacgggagcccataaatagacggcatccgcatccgctttgcttctgtggtctcgagtaattaagtgctgtgatgttagctgctggtggcgtcttatgttgctcgtggcatcggccacgtgctctgtattttaagtttggatctactaaaaggcaagcaggcaccatactatggtctttctttttctttttatgaataatgactttaagaggtaagatttctttttgctaaatgatttatagatagttaatgcttatctagaggaaaactggcatagcacttcttatcaggccaatatagaaaaggaattttatatttagtcatcccatttctgaatattttcatttatttaagtattaagagttttctgggacactctttgttgataataaaggaagagaagatgaattctcttctgtatgaagtcctggtggtgtatttgatcacaaaggagtgactggctgtgcagtgaagccttctcagaggatgtgtattttaagaatgcaatggagaaagttggaagcaatcttgaattgccagctctgttgttgggaagtcttgacaggaggaccttctatcccctttccttggtgctggaaggaacaagagccaggccttcagctccaccaagggctcagtgttgcccggggcatcagcaccaggtctcagattagtctcagttcttgcaacttcagggtttgtgagtgaaacggtgaagttcatattacaaataacaatagtgtttgatactgagaataagagtgaacaccgttgtcacctgatgggtgatcattttgaacaatgaagagactggatgtgtctcagcgtacgtggaagttgttgtgaactatttatgcctgattcctaggctgttgccttagcatcttggtttgaagggaaacccctcagtttattttggggacttgagtagctgaacaccaagtggaatgtcaactggctgcaatgggccacatgctttttctttaagatctccatgtccggctgtgattcagattttgggttgtttccatgatccgtgcaaaggcattagaccttttattgttgtttttttgtttttgttttttattttatttttttaattagagagaagttctcgctctgtcacccaggctggagtgcagcggcattatcatagttcactacaccctcgaactcctgggctcaagggctcctcctgccacagcctcccgagtagctaggtctacaggtgcatactaccgtagacactcagccaaaatggaccatgttaagaattagatttatctcttagtgttgcacaagtgaccaattacactgagctacaacctctagtgataaatgaacctttggatattaaccgtggctacagctcatttctacagaaatcttaaaatgctaaatgctgtatcactctcaaatcaagtggggtttttaagttagtacccatttacaaaaggtgtgctaggggctacacaaagttcctgaagccagcccttcactatggggaaggagataggatgacaaggggtggtggttaaagacacacatgctgagtatttaacaggtagagggacatggtgtcgggtaaggtgcaggggatgagcaccgcatcgggatgggctctgatttccctaataagacaacaccatcaccgctttggtatgaaggtcacctatgagtgatgatcacatcatgggcgtgggccagctgacaaagcgcttcctcagctgtgccctggcctcacacgggacacatggtggacacctgacaagacttagggcacatgtattgcctgttggttaccagcattcatgggggtcttgctcacctacagggtgatcgggggatcttgtttcttttttttgaaaagccatcttttcttcctataattgttagcaatacctccgtggattttgtttgcttcgttttgttttttcccgttttcccatagcatgtatttctatttcttttaataagaaacaatttaggtagagcgaaacccaccttttatagagaactgctccccaggttttgactaaggcgtcccttgtgtaccaccacagctgtcaaggaacatatagcagttctgttgcccccagcatttctacccctctttatagtcagcctctcccctgccccttgcaagccctgatctgttttcagtctttatagttcttctggacagtgcaggaacatcgccatcttggacaagcctctcattctaaaagttcaccttaaaaaaaaccgcctaaatccaaggggcatcagcctaatggctaaggtcaacacgaccatgaaccataggtaacatctccaaccagaaacattccaaactcctccctgaccagagacatggtagcccctaaataagctctctccagccaggaagatgccaggcccgagttaacccccctccgggctgaaagatgtctgcaccaagataacctcccctcctcccagagagattccaacccagccatgaacttctccacacacataaacattccaagcttctgataagccccctcaccccaaaactgatatatacttttagtctgtaagagaaagtgctcctgaccacaatcagccaggagtgcctctcaggttttaactaaagaaaacctgtctttgactgccacgccgcatttcgtgtttctttcctctttctttaattcttacacttccttttccagaatgtgaaatcaatggaatcatacggcatggcgtctttcctgcttggcttctcccatgtggtgtaatgcatttacattatgcatctacattacatacgcatggccatgctgttctgagtgtcagtagttcatttgtttctgttgctgagtttcattggctgatcatgatacaatttgtttatccattcgtttgttggtggacatctgggttgtttccagttctgggtgattattacaaaagcgtacaggtgcttttgtgaacatatgttttcatctgggtgtgggaagttccttcaggacgaggctcttagttcattgtttttcctcctgagcagatggcatctttactcaaatatagcaactgcttttgagttagtgatagtcccttttacataactattttgttgaatgagattattgctgaattatattttattgtgagcatttacaatgaccacattgaaagtccagcctataagctttgtatctttgctaccattagtgagttttcttctctagctgttgaatgctttccactaactcaaggttttgtgtgtttcctcacacagctgaggctaccggccattgactcaaagtatctgagcaaagcaggcaccccacttggccctaagaatcctgcaggaagtagactctccttcccccccgtgtaagtgcttgagctacgccctcactgtctggactgggtttgggtttggccttccgtctttcatccggtgatgactgcgctagtgacagcatccacacaacttcccgaagccctgtctgtggcctggcctggctgtgcctgtcgcctcctcactgtggtttctgttccttcctaatgtcattttgcccctgttgaacacatctgcccttccaggtcatgcttgctgcaggttggcagtgtggaggctctgcttctccatcaggctgtgccctgcctgaagcactccccctccaagataccaccctcaccacagttcacggggactgcttgtcctgcatgtaggggccaccaggtcctgacgtttctgtgtccaaggcctgaactgaggtgtccgcgccttgtaagcgtgctggctctgtttccagttggaagatatagcagacacactgacatttgctgatcctccagctgcagagtgaaatccctgaggccttaggtgtcttcttactctcccagaatccaagtttaatgctaggataaatgttattaattacctgactaattcttcaaacagcttcttgtccaatggggaaaaaacaatcagatacattgcattgtgacaaatgccatgagagcaccaagctcagagggaaatatacatgtattcatatgtgtttatatatatgtaagtatatatgtatacctagacatgtatttatagatgtacgagagagaaaataaagcattaggagtggccttgataacaaagtgattgaacccctcctgggcgcaagaaatcctcccacctcagcctcccaagtagctggggctatatgcatgcaccaccacacccagctaattttttattttttgtagagacaagatctcactatgttgcccaggctggtatcaaactcctgtgctcaaaaaatcctcctgcctctgtctctcaaagtgctgagatggaggcttagagagaacaggtggtgggctgctactgctcgagctgaaagctcacactacctctaccgtgtcaaactgccctgtcactcttcagtgtgggtcaggataagatatttgaagatgcagtagatggtgaaaggctaagctaacatcaagaaatgactggagacaaacctgtgtaagagagtaaaatagcagcagataatcattgataaggacaagaaagaaccaataagaaagtaatcattacactttttttgagatggagtcttgctctgttgcccaggctggagtgcagcggtacgaactcagctcacagcagcctccacctctcaggttcaagtgattctcctgcctcagcctcccaagtagcgggactataggtgcctgccaccacagctggctaattttttttttttttttttttggagacagagtctcactctgtcccccaggctggagtgcagcggcgcaatcttggctcactgcaagctctgcctcccgggttcatgccattctcctgcctcagcctcctgagtagctgggactactgtgtgggctaattttttgtatttttagtagagatggtttttcaccatgttggccagagtgctctcgaattcctgacctcaagtgatctgcccgcctcggcctcccaaagtgctgggattacaggtatgagctactgtgcccacctccctccctcccttcctcccttcctttcttcctttcttccttccttccttccctttctttctttctctctctctctcctttctttctttctctttttcttttctttctttttcttttctttctttctttctttctttctttctttctttctttctttctttccttccttccttttctcttctctttctttctttctttctttctttctttctttctttctttctttctttctttctctttctctttctttctttccttccttccttccttttcttttctcttctctttctttctttctctcctctttttttctttcttttttttttctctctctcttctttcttttcttttttttgagacagagtctcgctctgttgcccaggctggagtgcagtggcacgatcttggctcactgcaacctccgcctcccaagttcaagcaattctcctgcctcagcctcctgagtagctgggactacaggtgcgtgccaccatgcccagctaatttttgtatttttcgtggagacggggtttcaccaggttgaccaggatggcctcgatctcttgacctcatggctgcctgccttggcctcccaaagtgctaggattataggcgtgagccacggcacccagcagtttgttgttgttttttgttttgtttttaaaggtagttctgagcaatccattactatgagggaagggcatggtgttttcttaggaaggcttccctgtgaaatactagaattattactaattcttaattgactatcacaaagaaagattttggaagctgaactaaacatgctctcatccctgtacaagggatgctttgacatgcacttgctatgcttaaaaatggagacagtgagacagagaagcagagggagagacaaaggggcagagagagatagagggagaaagagagagggaaagacagagagagagaggtttgttaggtttaaagggacagtgacacctcctatttggtgtgttcacggaatactgcttctgctttatcattaacccttgtacttaagtttcacattacttttactctttttaaggcctggtcaaaaaaacagttcacctaccaatttttccaaactcattagcaatggttataaggatgagtggttgcagcagcagcagcgagctgactcagacaagaggaccccgaagacctccagggcatcagtgttatctcagtccccacgagacctggaaggtccccaggatgcagccaggctccaggatgcagaggcttctgaaggtcctgaggacaccccaggtgaggcacaagcagccatctgcatttattggaggcttggttaattgtgatgcagcagctgacgttcttatcacatgatgcgtctcgtaatgagaaatgagtaacccaaaaaccatgtgaaaacgcccacagaagtactaaggttacagataagcaagagagtaatacatgttttgctctttcctctttattcaaatgaatagcggaagtcatgacttttggggtttcacattttcttttatttgtcaaaaattttgatagtccatttgatataacaaacaaataatataccaaatagtatcaacttttaatcttccagatccaaacaatgttgaccctaaaaggacttttgcataagcagccggtactttttgagatcacttcttaaaaagctttgaaaataagtcaaaattcaaacttaaaattactccattattggcatgtcttaagctttgaataatttagaactttctccacaattagatgttcaaagtactatattagtttttatttattataatattttattttatttatttattttttgagacagagtcttactctgttgtcctggctggagtgaagtggcacaatcacagatcactgtagcctcaacctcctgggctcaagcgatcctcccatctaagtctcccaagtagctgggactatagacatgcaccattacacccagctatttttttatttttcataaagacaaggcctcactatattgccccggctggtctcaaactcctgggctcaaacaattcttttgcctctgccttgcaaagtactgagattacaggtgtgagtcactgtgcacagccattcatttttatttttaatagtacagaaagaattcatcttattttttcaacacatccatcttaaagcctattgacattgtgttcagtatccatagctctattaattattgaccatttgcttctgggaaacctgtttttactcttgaggcttgagctctttgattaagaggaaagatggcgtgttatacctcttcagacatttgaagtgtttggtgtggtgtggttatttgtaagtgaggtcaccgtttgccattctacaccctgttccttactgtatttgttgaacaagatctgccacttattggccaactctctcctttattatcctggaagatgagatggtgacaagttcatactcagtgttgttaaaaagcaccctattggctgagcatggtggctcacgcctgtaatcccagcacttcgggaggccgaggcaggcagattacctgaggtcaggagttcgagaccagcctgaccaacatggagaaaccccgtctctactaaaaatacaaaattatctgggagtggtggcacatgcctgtaatcccagctactcgggaggctgaggcaggagaatcacttgaacccaggaggcggaggttgcggtgagccgagatcgtgccactgcactccagcctgggcaacaagagggaaactctctcaaaaaaaaaaaaaaaaaaaaaggtttgttgccctattgaactttacaatgtcaagagtgttttatgacttattgttgttttaagtaatacagaattttcattaaatctttaagtaattatgacttcttttaatacttgatctgtttcattaacctgaacaacgaatgtactttttattacagagtcttctcaaagtgagtacttataaagtaaccagcaccaaaacacaaaaagtcttacacaaagaaattgatggacatagtcctgcattctgagactacagcctctaggcagcctggaatgtccttctccaaactgcatgcattctgactacaaagcttgtgccatgtatgctttaaaaaaatcagagttccagaaacttaacttagggagagcaaaaagaggatcgcttacacaattacaacaggatgaagatgatgatgatgatgatgatgattattattattattattattttttttgagatggagtctcgctctgtcgcccaggctggagtgcagtggcgcgatctccgctcactgcaagctccgcctcccgggttcacgccattctcccgcctcagcctcccgagtaactgggactacaggcgcccgccacaacgcccagctaattttttgtatttttagtagaggcggggtttcaccgtgttagccaggatggtctcgatctcctgacctcgtgatccacctgcctcggcctccgaaagtgctgagattacaggcgtgagctaccgcgcctggcctattattcttttattcatgttacacaagcaaaaacatactttagttcatggacacacattgtattactcgtcatgtgagagtcatactggaaaacataagtaaaaagccatcggagactccaatttattttttagtttactttttattttattttaaatcgacagataataattgtatacaactatggggtgcaatgcgatgttttgatatatgtatacattgtggcatcattaaatcaaggtaactaaaatatccattacctcaaatacttaccctttttttgtggtgatcacacttaaaatctgttcttttaatgattttgaaatatacaatatattattattaactttattcaccttgctgtgaaatagataattaaaacttaactcctcctgtctaagggaaacttggcaccctttgaccaacttctcctcttaccccatcaactactgccccatccccagcacctggtaacacattctattctacttctatgagttcaatttttttagattccatatatggctgcaattatacagtatctgtctttctgtacctggcttattttacttagactaatgtactccaggttcatccatgttgtcacaaatgacagaatttacttcttttttaaaggctgaatagtgttccatcatgtatataccacattttttttccttattcatctgttcatggccagtgaggttgattccatagcttggctattgtgaataatgctgcagaaaatttgggagcgcagatgtagctttgtgacatactgattccatttcctttgatatatgcccagcagtgggattgctatatcatacgagaattcgatttttagttttttaaggaaactccataatgttttccattatggctattctaatttacatttcaccttcagtatgtaagggatcccttttctccacattatcatcaacacttgcttttcatctttttgataatagccattttgacaggtgtgagatgatatctcattgtggttttcatttgcatttccctgatgatagtgattttgagcttttttgtatatacctgttggccatttgcatgtcttcttttgagaaatgtctatgtaagtcctttgcccatttttaaattggattatttgtttttttgctactgagttgagttccttatacattttggatattaaccccttatcagatgtatggtttccagatatttttcctgctctgtggcttgtcttttgttgtttgtttcttttgcttgcagaaactttttaatgtagtcccacttatttttccttttgttacttgggcttttggtgttctgtccaaaaaatcattgcccagaccaatgctggggaggtttttccctatattttttctataggtttagcatcccaaatctgaaaatctgaaatcaaaggaaatgctcattggaacatttcggattttggatttttggatttgggatgctcaaccagtaagtatgcaaatatttcaaaatttaaaaataattgaaatcccaaacacttctggtcccaaggatttcagataaaggatactcaacctatagcagttttacagtttctggtcttttgtttaagtcttcatctattttgagttgattttagtatattaaatgagatgaagatccaattttctttctctgcatgtggatattcagtttacccagcatcatttattgaagaaactgtcctttccctcattgtgtgttcttggcacctttgttgaaaattaattgactgttaatgtgtgggtttatttcttggttctatccactgatctatacttccatttttatgccagtaccatgctgttttgcttactctagctttgtaatatattttgaaatcagatgatgccatatatctgtttttttttttttctgtttgctcaagattggtttggctattcagagccttttgtggttccctacaaattctaggatttattttctatttctgtgaaaaatgtcattggaattttggtagggattgcattgaatctgtagattgttttgggtagtatggacattttgacaatattaattattctgatccatgtatgtaggctatgtttccatttatctgtgtcttcttcaatttatttcatccatgttttatagttttcagtgtacaggtctttcacctccttggctaaatttactcccaagtattttttaatgctgttgagagtgggattgtttccttactttctttttcagatcatttgttgttagtatatagaatgctaccaatttttgtctgctgattttgtagcctgcaactttactgaatttgtttaccagttttcacagttttttggtggagtctttagggctttctatatataagatcacattgtcatcaaacagaatatttcacttgtctctttataatctgaatgatttctatttatttttcatgcctaattgctctggctaagacttcaggtactaagtcaaatagaagtggtgatagtgagcacccttgtatttctcctgatcttagaaaaaaagctttcagctttcattggtgaatatcatattagctgtgggcttctcatgtatggtctttattgtgttgaggtacatttcctctatgcttaatttgttgagagttttttttatcataaaaggatgttgaactttgtcaagcacttttcctacatctattaaggtgatcatatggtttttgtccttcattctattatgtagtatatcacattctattaatgtagtatatcacatttaatgatatattatgtagtatattaacattctattaatgtagtatatcacatttaatgatttgcatatgttgaaccatccttgcttaccagggataaattccacatgatcatggtttatgatctttttaatgtgctgttgaatttggtttgctagtattttgctgtgaatttttgcatctatgtttatcagggaaattggcctgtaattttcttttcttatagtgtccttgtctgactttggtatcagggtaatgctggcctcataaaatgagtttggaagtgttccttccttttcaatttttttgggacagcttgagaagggttagtatgatttcttcctttacatgtttggtagaattcaccagtgaagccattatgtcctgggcttttctgtgatgggagagttgttttttttttaactgattcaatctccatactcattcttagacagttcaaattttctatttcttcatgattcagctttggtggattgtatgattctaggaatgtatccatttcctctagactatccaattcgttggtgtataatccttcacagttgtcctttgtggtcctttgtgttttgcagtatcagttgcaatgtctcctctttcttttcttatttttttcagtcttttcttttttcctctcttagtctagctaaatatttgtcaattttgtttataataaaaatactactctaacattttttatctcttctatcttttcttctgctaaccttgggcttagattattctttaggacctcaagttgaaaatacaaatacagcaggtacagaagatcaccttcataagatatgataagggttttattattctgcattgtcttaagaagatagaatttacttcaccattgacaaagtattacatattatctgatcaagggacgatcatttggcattcatataaatgtataaactttatattgcaggtgttatgtaatctttgtgtttatattatcagcaagatctgttcaattttgaagaaaccttttaacgtttcaaattaatgaaggcctaaataagcagcaaagcccctaagagctggaagaatcgtcatgtggagaagaggatctgctctgcttagtttctggatagctgaggcgggggtcactatgaaatgcctgctcccacctctcagtatctctgatgccaaggctagtgctagagcttttgacaaccacactctctccactgtcagtctgaccactattttccttcctgtatttcatttcctcttctgttttcctatttcccctgctgtccctcatggttttaactttataagcaataggcaatttagaaagtgccttttttccttccaactagacatctctccacttagagtgtgttgctataactttctggagactaatcttgtcaaggcttcttattttatttttttgagacagggtcttgctctgttgccgggcctggagtgtagcggtgccatcatggctcactacagccttgacctcctgggctcaagtgatccttctgcctcagcctcctgagcagctgggactacgggtgcatgccaccatgcctggctaatttttgtattttttgtagggacgaggtttcgccatgtggcccaggctggtcttgaactcctaagctgaagcaatccacccacttcagcctcccacagtgttgggtttataggcgtgagccaccacacccagcctaaggcttcttcttaatgtttctttccctccatgagacacaagattattattatttctttattgcaatttttttcagctgtcctagatgttttgacgtgccctaaagctgggcattaggaaactggtacactactgtactttgagagggtcaacattaatgaagattgcaacaggcttgggagcagggacacgtgccatgccgaggctgacagacagcctgagttgcccctcttctctactcgccttgcccaggctgtgctcatactatttatttaataattcttatcggtgtgcttatgtcagcagaaactttccaccatacacaggcaaaactcatgaattgaactgtttccaatggggcattctcttctggtctaccagtgcaaaagttgtaatcttgtgtttccaatgtattatttatgccaggatcataagctcaatttttatgtagacttcagaaataatccttattaataggtacaaaactatgtgttttcttatatttaaaattaatgttttttaatttatagaaaatgtcatctttgtctactcatttatttactttgtgttgcaggcccagaagaatctgtatctgcatcaacaccagcagagctcaaataaatcctgatgcaatatgtatttaggataatttttaaatggctaaatatgacatgactgtattatagctatatttctgaggctttttttgtattttattaatatagactctcattgaataatttaccttgcagcagatttgacattgctgcatagaaggggcaggtgttggtttttgtttcttgcatttctctgggatgtgaaacacttggctaacaaacacaactaaggcctctggtaccctctgccctgctggcctggtgatgtcccagtgtctcagaactgatcacttgctcctcctattgtgtgaaccactcttagcaggcattgctactggattcttaactagagaaaacttacagaacaggtgttaagccttttccaatatttagtattgtagtcttcatagaaatcatttctagttacagaaaaatttaactccagaatatggtgatacagtttatgttaagaaacatattttaatttattatgccatgaatttataaacatttaatataaaacattataacatttgctgttttaaaatttttgctattttttcacaaactgatattcaaaatattaaacatttgttattttgtataaacctttaagtaaaaatatgctgttttaatatttaatttagtagaattaacaaaaactttttaatagtcaaactgaattaccttgttttataaatgttaaattgtttatatttaagtaattagcttaaaaatatagttttatgttttgtacattaattgattaataaaataataattttatgtgagaatgttttcaaaaagccaaataaagtcacagatattttagcttctttcccagaataaacttatcatgcatttgcttacctaaaatttaagtttcaaattagttctctatatgagatacttaatcgagcatatatatttatattcattgatcaaactgatatgctacaggagaatgtatgcaatgtgtaaaaaatgcaaatggctgtatgcattgaataaaaataatatacaattagagtaagaagtttgttttttccctttcctattctcttcctttctctatattctcttccttccttacctcattcccagacacccccaccttaacaaaaaagtcatcaggaacagatatcaatagtgtagaacgcttcaattatttgtttagattattatagtaacagaaacctgtggtttaggaaaaatggggacaaaatttggagtaaggaccagtgatcaaatttaggctccacctacagtagccagtgttgacctaaacaacaagcagagaggctgtctgaaagcaaatggtatttatttgggaatgaagcagttcaatggaaatatagtaaaccatgcacatatagtaaactgcgcacatattcatggaggtcaaggaagacaaaaatagggaggattacataattgttttgacataattatccttgactataatgatcaataatgagggtgatgccagtccaggtttgaacaggcagtggctgaatagatgtcctcacagaagtatttttttaatgtatggttgcaataccctttgttcaaggttgcagttttatagagtcttttgtgatagcttttgctattctgtgcaattccaactatatggcatgctgggaatggaaaaactatggctgcagtaaaactatcactgatagatggggattagggaggaagaatgaatagatagagcacagaggaattttaggccagttaaactactctctgtgtaatgctacaacggtggaaatatatcattataagtttgtccaaacccacagaatttataacaccaagagtaagccttaatataaactatgaacattgggtgataatggtgtctcaaaatgggttcatcaagtgtaacaaatgttatcactgctgctccaggtgttgatggtaggagaggctgtgagtgctgagaggaaaaggaatatgggaactctcttctttatgctcaattttgctgtgatcctaaaactgacccaaaaagtctattaaaaataaaaaaaataagataatgccctacatgtcataaaaaaaataaaaactacagtgtaaaaaaagcaggttgggcatggtggcacatgcctatagtcccagctacataggaggctgaatacagactattgcttgagcccaggagttcaagtccagcctgagcagcatagtgaggccctgtctcataaataaataaataaataaataaataaataaatatttttataaagcaaaaagtgttgggtttgctgcctgcagtgctaaatgatgggatatacaagtggttgtatcacatcccttgagttaaaggttaaaaaacaacagatcaacttaggtctaaaggacaaatcagcattagtaacatttaaaaatgaaaataagggtgctcacctcagcagcacttatactaaaaatgaaaataaggaggaaaaattattttcaagtctttttgtccttagagagcaaagctcagcagctttgacaggctctcacactcttagtttagattgcatgtgggagctctttgtgaaacaataaagaggctgtctgtgcagttttaacaagtacaataatgtgctacagaaattctgattcagtagcaagctcttcaggtggtaagacatgaaccctcctttgagacatactgccctgtaacctgggtcaatgcaagtttgaattaaaagattttgttttgaatgtgccatgtttttatgaggttactaaaagatttgcaataaagtacaacttttctacccaagaatatcctaatttctttgaaactatccattatgtattaatatgtagctattccttgcctcatgaactatagatgtacaattattttaaaactccatcttggggactttctggtagttaagataattataaccatctaagctaaatctccccacacatcatttaaaaattgagcagatcaattaaccaaattgagcagatgtaccaatctttgtacagctataatataaagacaaccaccaatggcccatttcttcagcacaattagaaaaggaaggacgtcataagcttaaaatgacctgtaaatagacaaacataaacttccagtagagtcatttctgtagctcccaccacacactttactgaagatgagggaggatccagaaagactccagaaagagaagcaagggtggaggtaaaactacctgcagaaggaaaagtcccagttatgtgggaacatagtaaaaatgcatggtgaaggggaaatcgaagtggagaaaatggaagactctatcaaacaacagtaaaccaaaaaaaatggaaggacacaccatccctcccctgtacctatgaaaacagccactcaagaaaaaagtctttacatctcactactgatagaagatggcacatttgaattgtataaatcatcccagtagacaactctattcacaaaataaaatatattagaagtctttatctattaagagaacaataagacaaaggcaaaaactgagaataaaaatattttggctgataaaaattttctccaaaaagttaacagtgaaacacctctattacaacaattctcaagcaagcatttagagatttttaaaatgtatacacaacaacaacaaacatacactctggcttggaaatttaaaaactaagaacagaaattaattccatcctgtaaaaaaaagaacaaataaaatgagagtttatttaatttcaagaagaaaaagaatcaaaagaaaaattatatcagaaataaggactataagatgcccaaaggagaacagattccaataaaaatgtaatatgagtcattgaagaaaagaaagaaaagaacgaagagagtgaaaatgagatgaaatggaaaggattagagggaaatttgttgaaatggaagacaatgaaagaagattaaacatatgtacaattggattctctgaagaaggaaaaagctatatacaatggaacagaactaatatttataactgtaactcaagaaaatatttcagaaataatacttgaatctacatattggaaagatccacaatgtaccaggaaaacttatttgtaacaatgtcaagacatattctaataaaattataaggttttattgtaaataaaatatccccagttctctaaagatctaataacttacaaggtcaaacaaaattatccggcgtaagatttctcaaaagcaatatgcaaggcaacactgaaatagcattttcaagaaactcaatgaaagaatatatgaaccaagccaaactgtccctcaagtgtcaaggctatagaagaacagtttcaaacttgtaagaatgagccttttctgaagcaccagctagaggatgagactgactcagctaaaaatcactgaagaaaattcagcaaaaggaccactgatgagcacttaatatagttaattgtggacctgaaactaaaataaaagtggggaaaacatgaaagagtaatatataaatgttctatgttctgacaaactagaaataacataactaaaattttagaaaaggaaaagataaatctaaaataaaccctttggtggataggtcatacacagtactcaaagaataccattagaaactgacaaaacagatagtaaaaaattaaataagaaaacagaaataagggcactaagaaagacataagttaaaaaaataaaaacaaaacattacagagaaagaaaaatagtaaatataatactcataataattacaataatgtgactgaattaagactacacctgtaagtcatatcaataaatgcaaatgagcttaactcatctgttaaaagattttcattttggtttacaaagcaagacacaaatgtcatatgctggagacatgagacacatctgaaacaaaggattcagaaaggctaaaaatgaaatgatgagcaaaggcataccaggaaaacagaaataatagaaaacacaggtagcaatatttatgtcatacaaagtaaaattcaagcaataaacattacatgagacaaataaagaactttttaatactaaaagccagaagtcatgggaaagacagtacagttatgaatatctaagtatcgagtataacagagaccacttttatgaggcaggaactacaggaaatgcaaggagtcaactactaataggatactttaacagatcactctcagtgcaattcagatcaaccagaaaaagataacaaaggttatagaaggcctaagcagtgtaatcaatatgataggtcgtacggatatatatcaaaagttaagatgcgataatagaatgtataccttcaaatgcatgcacagaatattcacataaatagttgttatactggaacacaataatgtagaaatgtgcaaatactactctgaccacagctcaataaacctggaaattaatcacaaaatcaataaacttaaaaaaattcccaccaggaaatttttgaaaacctgcacaacttatatttaatgcccttgatgaaagagaaagtactaacctaaattacaaaatttctaaaaataaatataataaaaattctcctagtaaggacctatgagaactagacctaacacatatatacagagcactacacccaacgacagcagaatgcaaattcttctcatgtgtacatggaacattctttaagacagagcatacattaggcaacaaaataagcctcaagaaatctagtaagatggacatcatacagcgtatcttctccagccacaatggactgaaaccagaaattaataacaggaaaactggaaatttcacaaatatgtggaaattaaacaacacatatgtaagtgaccagttggtcaaagaagacatcacagggaaattaggaaatagtttgagatgaatgaaacaaaagcacagtatataaaaacttatggaggccaggctcagtggctcacgccttaatcccagcactttgggaagccgaagtgggtggatcacctgagatcaggagttcaaggcgagcctggccaacatggtaaaatccctactaagaatacaaaaatcagctgggcagggcagtgcatgcctgtaataccaactactgcagaggctgaggcaagagaatcgcttgaacccaggaggcggaggttgcagtgagccgagattgcaccactgcactccaacctgggcgacagaatgagactccgtctcaaaaaaacagaaaacaaaaacaaaaaccaaaaaaacacttatgggatgcagtgaaagcaatggtcagaaattataaatttagacaatttagaaattttcattataagtttagaaatttataattcctgaccactgctatcactgcatcccataagtttttttaaagtttttatatgttgtacttttttaatgtaaacaaatacatgaaaaaagaataaagatctcaaatctgtaacctatctttacattttgaggaactataataagaacaaactgaacccaaagttagcagaaggaagggaatgatcaagattaaagcagaagtcaacaaaacagagaataggaaaaaatacacactcaatgaaaccaaagttggttctgtgaacagattaacaaaactgacaaactgttagctagaatgatgaagaaagaaagagagaaaactcatattaccaaaaaaagaaataaaagtaaagacattgctaccaacattaaagaaattaaaaaggattataacactatgaacaactgtactccaatagaattagataaccaagatgaatggacaaattcttagaacactcatattacaaaaagtgactcaagaagaaataagaaaatatgaacagatctataaaaattaaagatactgacccagtaatcaaaaacctcccaataatggaagtagttttcactaattaccagttatgaacaacaatctttctccagctcttctaaaaatcgtaaaggaaggaatacttcctaactcatgaggccagcattactttgatcccaaagtcagataaaggacattgcaaaaaaagaaaattactatccaatattccttatgaatatagatgcaaaaatatttaacaaaatactgtcaaactgaatccactagcatattaaaagaattaaatgtcatgaccaagtgggatgtatcctaagaatgcaaggctggctaaattaatcaatcacattgagggaatgaaaggaaaaaaaaaccataatcatctaaattcatccagaaatgtatgtatagcatacacccacaatatatccaatatcatgttaaatactcaacacaccaggaattgaagggcacttccttaccctgataaaggacagttatgaaaaacctgcagctaatatcaaaatcaatgatgaaaggctgaaggctttccctctaagatcaagaaccagataaaaatgcctgcttttggctgggtgctatgactcatgcctgtaatcctagcactttgggaggctgaggcaagtgggttgcctgagctcaggagtttgaaaccagcctgggcaacacggtgaaacccgtccctactaaaaatattaaaaaattagccaggtgtggtggctgggtgcctgtagtcccagctacttgggaggctgaggcaggagaattgcttgaactcgggaggtggaggttgcagtaagatgagatcgcgccactgcactccagcctggggacagagcgagattgcatctcaaaaaaaaagaaaaaaaaaaaaagcctgcttttgtcacttctatttcaacaatgcactgcaattagggaaggaaaaaaaaaggcataccagctggaaatacagaaataagtagaattatctctatttccaaatggttctacagtttgagtgttggtgtctccctacttcaaattcccaattaagatagtatttagaggtggggacttcaggaagtcattaggtcatgagggcagagtcctcataaatgagattagtgcccttatagaagaggcttgagagaacctgtttgccgctactgccatttgaagatgaagaaagaagccaccatatttgaagcagacagtgactcttccaccagacactgaatctgctggccccttgatcttggacttcccaacttccagaatagtgagcaataaatttctgttgtttattaattaagaagtttaaggtattttgttatagcagcaggaacaaactgagacagatggaatgatcttatacagtgcagtatacagaaaatcctaaagaatacacacacacacacacacacccctattatatggcctatggccaataaatgaattcagcaaagttgcagcatacaaaatcaatgcacaaaaatcagttgcatttctatacttcaacaatgcataatctgaaaaggaaattaagaaaacatttccattttcaatagtatcaaaaagaataaaatacttagaaataaatttaaataaggaggagacttgtacactaaaaactacaaaacattattaaaagaaattgaagaatacagagtaaatccagagacatctgtggtcatggattggaagacttaatattaagatggcaacactcctccaaacaatctacacacttaatgctatactaatggaggcagagtggtactggcataaggagagacatatacaccaatggcatagaactgagcttccagaaataacatcatatgcctacagtcagttgattttaaacaagggtgtcaaaaccattcatggtgaaagaacagtctgaagttctaaccctttaactgtatcttggtttttcctaatcctgaagctaatctaggggctcctaaccaaaaaaggcatctcattatcgtataaatgacactctttttcactctggagattccacaggttttaggagttgtgtgccaaaaaccaaagacaaaacccgagtaacttttaaaaattataacacagtatatctggaaaaccctaaaaaataaataacaaaactaactcagactataagataaaccaatgttattggcatatatgatcaatatgcagaaatctgcaatataaattttttaattgacaaatacaatcgtatatatttatggtatgcaacataatgcaagttttgtatacacaaacaatgaccatttagatgataaaatagtagagaaaattccatttatggtaacaaaaaaggagactaaatatttgggaataaatttatcaacaagtaaaatctacatgagaaaaaattttaaaacactccagaagacataaaagtagtcttgaactagacatcccttgctttagccaggatagcaacattataaggatgccagttaatttataaatttaacacaatcccaataaaaatatgaataacccttttgaagtcaatactaaaatccctacagaggtcaggcttggtggctcacgcctataatcccagcactttgggaggccaaggcgggcggatcacctaaggtcaggagttcaagaccagcctgattaacatgatgaaaccctgtctctactaaaagtacaaaaattagccaggcatagtggcaggtgcctgtaatcccagctactcaggaggctgaggcaggagaatgacttgaacctggaaggaggttgcagtgagcagagattgtgccattgcactccagcctgggcgagagagtgagactccctgtcaaaaaaaaaaaaaaaaaaaaaaatccctacagaaaagaaaatatgcaagaatagaatgaaaacagttaaaaaggaaaatctacaagggagactaggccaactaaaaagtaaaacataccaaaaagccttcataataaaacagtgtggttctggcacatgaatgacaaacaggtcagtggaaaagatgaaaaaataatacaactacagacataggtaaatacgtgtataatgaaggtggcatcgcataatgaccgagaaaataaagtttttaatacatgggacaagtatacagccatttcgatagaaaaaaagagaaaaagagaaaattagatccatacctcacaccatacacaagcaatactcagcatggacactgagaagcacgtcgtcagttatgtggtgccaggctacagctgcaagctcctcatctctcagtcaagtgggaaggacaacagcgttgctaggtcttcttccagttctgagaaaagggagtcaaaattcatgaaacctgacagttgggtctccgccatcccagtctaaatgccctggtgagagtttaatctgtacatgatggcgaccacgagttaagacaccaggtgccatctggagtgtgagctacctgcagctcttcaagggaaaataggattcagatccactttttagataaaatagtggttctcagagcatgttcccaagggtgcttgggaatacccaagacctgttcaggagtctgctaggtcagaacaattttcataataatttaaaaactgtatttatctctttctcttattttctccctatattcaacagtgtttactgtactatatgacatatgattctatttcagattaaatgcagaagcagacctgagaatttaactgtctctattaagctggatagtgaaggaattggcaaaaatgtagaattatgccactcctcacacttttttttgttttgtaaagatatagttatgtttcatatacatgtcatttatactaatataatgggttaattattgttactttaaaataaattaataagtaaataggctaaatatattagttttaatttctaatataataaacatcaatagctaaatacctacatacacatttctttgaagtcttcagtgatttttaagagtgtaaaggggtcctgaaaccaaaatgttggaggtctgctgagttacagcaactcagagaggttaagtgacttccctgctatcacatagcatgtgtcagacagatgcctgtccacctctggacctttatgcgctttcctttcttgttttactgtgttccagcctttgcattaccccatacgatacacgcaaattggatgccaccttttgaaaacccttacttaaagaattttattttcatttggtgcagtatttgtgctttgccagtggagtataaaacacttaatctttccactcactcagacctggggctgaagtagtttacaggacaaggacaccaagatctccacttaggatgttacctagaaaggctttctgatatctcaaggttgtgcaagggaaagctaacaccatcatttcttttgagatagacctgctttgggcagccaactgccatggggtgaggtggtgtgggacacagaaggcaacaggggagaaataagcagaaaagaataaatgtccaaactgcttggcaatgcacagtgtatattacatagcatacaatgcacagtgtatattacaatgcacagtgtatattacagtgcacagtgtatattacagtgcacagtgtatattacatagcaatgcacagtatattacatagctgtatattacagtgtatattacatattacattacatatacacagtgtataatatattacacagtgtatattattgtatattacacagtgtatattacaatgcacagtgtatattacatattacaccgtgtatattacatattacaccgtgtatattacatgtgcaaaggtgtgcaatgtgcagtagaaagacacgcactttccctcgcgccactgcactccagcctgggtgacagagcgagactccatctcaaaaaacaaacaaacaaacaaaacacaaaacacacaaaaaaccagaaaactacaacccaactatatgctgtttataagaaactcacttcacttacaacacatgaaaatacaaaatggtcgtgtaccatgtaataatatttctgtcaatgacagagctcatatacaactgtggtcctataagactacaatactgtattttaaattacattttcagtgtttttgtatgtttagatacactaatacttaccattgtgctacaattgactgcgctattcagcatagcactatgctgtacaggattgtagcctaggaacaataggatataccatataacccagcctagatatgttaggtataccatctaggtttgtagaagtatgctctacgctgtttttacaatgaggaaattgtctaattgtctaatggtgcatttctcagaatgtatctccagtgctaattgaggaataactctacatcaaaatttgtgggatgcagctaaagcaatgctgagaggaaaatttatgcccatattagaattgaagacaggcttcaaatcaatattctaggttgtcacttcaaaaaactatacaaaagtagcaaactaagcccagagaaggcagaagaaaggaaacaataaagcttagagcagaaatcaataaagttgaaaatagaaaaacaatagaggaaatcaatgaaacaaaagtttgttcttgaaaaaatcaataaaatcaacaaatctctagcaagactgataagaataaaaagaaagaagatacaaacaccaatatcaataatgaaatagggaataccacaacagacatcgcagccattaaaaagatggtagaaaaaaacactaggaccaactttaccttcataaacctagtgatttataagaaataaatgaattcttcaaaagtcacaaactaccaaaactcaaccaagatgaaatacactgcttgaattgttctatacctattcaaaaaattgaattcataattcctcacaacttggaggtttcccacatggtttcaatgggaaattcaacaaaatgtttcaagaattaacgccaattttacaccatttcttttagaaattaaaagaggagagaacccttttcaacttatttcatgaggccagtattatcttgatgccaaaatgagatgagcacagcatagaagaggaagactgcagaccaatatttcttataaatttagattttaaaatcttcaagaaaatattagcaaacagaattcaagaatgtgtaaaaataattatatccaattaccaagtgaaatctattacaggtatgcaaggtggttcaacattcaaaaatcagttagtttagtgtagtttgccatgtaaatatgctaaagaagaaaaatcacatgattctataaattgacacagagcatttggcaaaattcagtatctacgtatgataaaagctcttagcaaattaggaatcaagaggaactacctcaatttgataaagaacatccacaaaaaaccctacagttaacatatttaatagtgaaagatgaaatgatgctttcctccaatgaccagaaacaaagcaaggatgtccactctcacccttcttattcatcatagtactggaaggcctagccactgaagcaagggaaaaaaagaaaataaaaggcatacaagtgggaaaggaagaaataaaactgtctctgtttgtaaatgagatgattgtctgtgtaagatttcccaaagaatctacagaaacactcttagaactaataagtgagtccagtaatgttgcagtttaaaaaacccagacatacaaataaatcactcttctatacacaacaatgaagatgtaagaattgaaaaatttaaaacacaatgccatttatgatcactccaaagataatggactgcttaggtatacacttaacaatacatgtacaggacctgcctgttcaaaattacaaaatgctgatgacaaagtttttaaaagacttacatatgtagagagacatactgtgtggattagaaggctcaacatagtaaacatgtcatttctactgttaaagaaaaatattattcatgactcttattaaagatagtagagaggttttattcaggacttttgcaacagatataggcaccactgtgatgggtttttacagtaggagagagagattgtgaaagcatatttgcaaaaattttgacagagaaacctaatatggctgacaacatcttgcttctagtctcacaggctgactgtcttcactcattcctgcacataggccaagctaatcacaggaggaatttagtttatagtttaagttggaaacaaggataacaatagcacttccctaaaactaagcccctccttgctcagggactcaaaattagtgaaaggccatgagattaggatcatgggagggacctgaactctgctaaaatgtaggcacagtttctataattctttacttcccaggagtcatgtggccagaggtcacaagattggtgacttcaccaattgctcctgtagataacatcactattgtagaacctaagattggtcttttgagatggttttcagatttttgccttctggcaaccagctgacttcatctggagccatgactcatggctctaccaggcatgtagcccacacccagaggctggctcaatttttcaatcagcagcaccaattccctagccccctacccaccaagttatctataaaaacttgtctctgagttttcagactgatttgagtgataaccccagtccttctgctcagctgccttgctttaattaaactctttctttactgcaataccatggtctcagtgaactggttttgtctgtgcaacagccaggacgaacccatcaggtgttacagctgggttcaacaactaatacaaggataagtgggaatttacagccaaggagctgtacagggtcagtagatagaaaattactaagagaaaacatctaggctaaggggattctggctaaactgaatcaacctacttgctgaagacaaggcaaggtgataaggtatctagggcaaataattagaaatttgatcagatatcaagcatacgggacttttgctaaattaactcagcaggattcttgctaaaactcaactaagtggacatatactatggactaaggacagatcaggttctagtcagaaaggggactcagaggccaggtgcagtggctcaacctgtaatcccagcactttaggaggctgaggcgggtgggtcacgagatcaggagatcgagaccatcctggctaacacggtgaaaccccgtctctactaaaaatacaaaaaaattagccaggcgtggtggtgggcacctgtagtcccagctactcggggggctgaggcaggagaatggcgtgaacccaggaggcggaggctgcagtgagccgagatagcgccactgcactccagcctgggtgacagagcgagactccattaaaaaaaaaaaaaaaaaaaaaaaaaaaaaagaaaggggactcagaggaatctgactcaagcttggtcaaaaaaagagaggcttagtcactacccaaattgatctataggtttgatacgatctctatcagaatcccagtatgttttgttttattttattttttcgcagacatagatgtgtgtgttctaaaatttatacgagctgggtgtagtggctcacacctgtaatcccagcactttgagaggctgagatgggaggatcacttgagcccaggagtttgagaccagtctgagaaacatggtgaaatcctgtctgtataaaaaaattaaaaaattaggtgggcatggtggcacacacctgtggtcccagctacaagtgaggctgaagcagatggattacttaagcccaggaagtgaaggctgcagtgagccatgatcgcacggctgtactccagtctgggagacagagcaagaccctgtctcaagaaaaaaaaagtatatggaaagggataggccttggaatagcttaacatcttaacaaagaagaatctaacaggaaaatcactctaccctatattaaagcctagtatagtgatgaaaagagtacagtatcgacagaagagggacagacacacacacgactcgaacagaatagaaaacccagaaacagacccacacaaataagctcaactaaactctgacaaaatgccaaagcaattcaacagagaaggatagccttttcaatgaatggtcctacagcaaccggatatccataggcaaaaaaaaaaaatcatcttcacccaaccatcacacctaaaaacagaccataaacttaactgcaaagaagaaaactgttaaacttttagaaaaaaacataaaaggaaattttcaggatctagggctgggaagagagtcttgacaacaaaagcacaattcacaaaagggatgatatatgaattaaaaattaaaatcaaattgaaaattaaggccaggcatggtggctcacgcctgtaattccagcactttgggaggccaaggcaggtggatcacttgaggtcagtagttcaagaccagcctggccaacatggtgaaaccctgattctactaaaaatataaaaattagccaggcatggtggtgggcacctgtaatcctagctactctggaggctggggcaggagaatagctagaacccaggtggtggaggttgcagtgagctgagatcacgccactgcactccagcctgggcaacacagcaagactgtgtctcaaaaaaaaaaaaaaaatcagaaatttttaaaaatgctctatgacagttcaaatatatgaagaggataaaacgacaaactaaaacagggaaaaaatatttgcaaacacgtactcaacaaaagactgatatctagaatatacaaagaactctcaaatctctacaagaataacaataacaacaacaacagaaaacccaaaccattcaattagaaaatggggaaaagatatgaacaaatatttcaccaaagcagatatacagatgtcaataagcatcaaaagatgctcaacatcggctaggcgcaatggcttacgcctgtaatcccagcactttgggaggccgaggcgggtggatcacgaggtcaggagatcgagaccatcctggctaacatggtgaaacctgtctctactaaaaatacaaaaaattagccaggcatggtggtgggtgcctgtagtcccagctacttgggaggctgaggcaggagaatggcatgaacctgggagacagagtttgcagtgagccgagatcgcgccactgcactccagcctggatgacagagcgagactccatctcaaaaaaaaaaaaaacaaaacaagctcaacatcattagccaccagtaagggcaaattaagaccacaatgagacactgaaacatcactgcacatccatcagaatccctaaaattttaaaaaatgacaacattaaatactggtgaggatgcaaagaacctggatctctcataaattgcttgtgggaatgtgagatggagcaaggacacctctcttagggacctgcagttcccccatccttcaagcacagcaataaaggaaaatcctgagtttcttcaagggaaattctaggcatgtagctggccctgagaagtacataagcaacctgataagcaagaaggtaactgtagcttagaacaatagccgaggaagctagaatcacaggatgtttggttcccctacagaagctaaagataatagcttcacatatgtccctgagttgtttttcaggaacccagacccctaccaaatggatctgccagcacatagacctcagataaggggaactggggactgaactcttgactatcattcttcattttaaattttttcctgaggggtctggaggaagtcacagccatgagccagaagtaacattctttgctgaccccaaattttaaaacaaagcttctcttccctagccagttggaaatcagagtatctttgaattaacctgtgacctgaaagctcccatttcatagcccatcctttaggccaaaaccaatgtgtgacctccatgtattgatttaaaattttgcctgtagcgtgtgctttcctgaaattacccctgccttaaaaacgccttacctggctgggtgtggtggcttgtaatccttgcactttgggagaccaaggcgggcagatcacctgaggtcaggagtttgaggccagcctgtccaacgtggtgaaaccccgtctctactaaaaatacaaaaattagccccgcatgatggcaggcacctgtagtcccagatactcgggaggatgaggcaggagaatcacttgaacccgggaggcagaggctgcagttggctgagattgcaccactgcactccagcctgggtgacaaagcaagactgtctcaaaacaaaaacaaaacaaaacaaaacaaaaaacccttagctgataggcatcagggagctcaggacttaagtgtgagctggctgatgctccttacttggtgcctacaaacctcagtgtggataactggttttcccatgccaggtgagtggactctatttcagttagataacagatataaaacattatagccactctgaaaaatagttgggcaacttcttatagaactaaacatgcaattaccataccactcagcaagtgcactctgggcatttatccaagagggaagaaaagttgttgctgagttgtatggtaattgcatacatgaaatttcatgccagctttattcttaatagcctaacactgaaaacagcctggatgtctttcaacaagtgagtcgttaaactatggcacatcacaccatggtatatggctcagcaataaaaaggaatgaactaccgatacacacaacatgggtgaaagtctgaggagttatgtggagtgaaaaaagccaattccaaaaggttacacactgtatgtttccatgtatgtaacattcatgaaatggtaaaattttaggaatggaagacagattagtggatgccaggcttagggttggagtgggtgaaggggaattgggggtgagatgggtgagctataaaagaccaaatgagggatcctgaaactgctgaggatcttgactgcgatggtatcacactgtgacagaatttttttttttttttttccttgagacggagtctcgctctgtcacccaggctggagtacagtggcgcgatctcggctcactgcaagctctgcctcccgggttcaggccattctcctgcctcagcctcctgagtagctgggactacaggcacccgccaccatgtccggctaattttttttttgtatttttagtagagacggggtttcacggtattagccaggatggtcttgatctcctgacctcgtgatcctcctgccttggcctcccaaagtgctgggattacaggcgtgagccaccgtgcccggcctcactgtgacagaattgtataggactaaatccagcacaaaatgagtaccagaaaaacaggaaatctgaagattggtggattatgttaatgccatatcctgggtgtgacaccctcctatagtttttcaagacattacctctgagggaaaccaggttaaggagtacaagggatccctctgtgttattccttaaaacttcataatcaattaaaatgcaatttaaaaaatgcaggggtcaatgggctagaatttcaggaatagggctctagaagaactggggttcagggaaggctatctgggagatgacctttacgttgagacctaaatgaggaaggaagagaagacgcctgcagggtgagtgaacactgagtggaaaggcgtggagcagcagcaggacatgttcagagagcaggaaaggaacccatggggacagctcaaggcacctggatgatctgacagcacttgtcctctcacagattcctggacatttccacaccacatgctttttggcttcctaagccaaaaagcacttccagaaaatgaacagtgaaccccttagtaatttatatcagcacacctttaagggtcatctctgccaggggtccccaatccctggaccatggatcagaaccagtgcatggcctgttaggaactgggctgcacaccaggaggtgagcaggaggtgaatgagcaaagcttcgtctgtatttatggccacttttcgttgctcatgttatcacccaagctctgccttctgtcagatcaggggcagcattagattctcataggagcatgaaccctattgtgaactgtgcatgtgagggatctaggttgtatgctccttatgaaaatctaatgcctggtgatctgtcactatctcccatcacccccaggtgggactgtctagttgcaggaaaacatgctcagggctcccattgattctgcatgataatggattgcataattatttaatatttcattatatattacaatgtaatagaaataaatgagcaataaatgaactgtgcttgaatcaccctgaaaccatcgcccccatacccccacgtctgtagaaaaaatatctgccaaaaaattgaggactgctgatctatgacaacatagatgtaagatttaaccaacctgaagtttttaaaaaagcagggatatagaaggtatctcagggcactgagtagttttttttttttttttcaccagtcgaagtttaataatttcaagatatactgaaaacaaaggcaagaaacacttaaaatgataacaattctcaaactcaaagtactgtttgtagacatcagatctaatgaggtcacatcacattaaaatgttattaaataattagctgtacaggcaatattctaagtactttacaaatatcaactgttttaatcttcttaagaaccctgggggagaggcactaatattaataccatttacaaatgaaaacacagagacagagagattaagttaatttaccagctgtcacacagctaataataaatgacgaaagtaagactcaaattcagcaatcaatggtttgatcccctgcactttgctgcatctcggagtgacttctgaggctcctgtagccagaaaggggcaaagcaaggtatagaacagagatttgacttccattgtctcatgctctttccataaaatcatctggtcagttcaaatgttcaactagtgttagaaagactaagaaattctatgtggtggactagtcaattgtcacaagcaaaaacagcaaaagaaatataaagtattcctgaaatcacaactttatgtgatatgattaaactatgatatacatttaaataccaacaacagaattcacaaactaacatatagaataattttaagtgaagtggctcattttgggttaaccccttgcaatcagctcacgtgatgtgaaaaaacaatataaccacaacccaaattaaaccaaagaagagctttcactgatatgaagcattgtttttgttaagccgcactacagcaaccatacccacacaaacagaactgacatatactaaagactttaccaataattagcaatgaaaatattcatgatgtcttccagcaatttaaagatacatcttctaagacaaacaataataatcagtgtatgtgcagcttttaaatagtgatttcatctttatgaaagttataacctcaaccttttaatgttgtgttttaaaaaaatcatacatttacacttccctaccaatgaaatttgactttttaaagactatagttaaaatttctatgctatttacaaggtaggataatagtttgacattcagttaatcaaaaatattatgtgttctcaagcatctgtaaatttagaatattataggctgaacatatttgtagagaattcaaactaccattattttattaagaacattaagtgaaacttgaaacttaacacatgatagatctttacttgtatcacttaacttatactgagtattttagcaattacatttttatttccagcaggtaatcaagaatacagattttcgtggcattggtggtagagtggtgatcatagctgccttctaaaaatgctgatttttatttatcttataaatgcgcaaaacgttttggagaaacaaaagcaaatttgaagtgagtaaaacttaacagttaacaccaggttacatagctggttaatggcagtccttgaaatacctagctcaaatctcaaaatcaaacaattgcatggggtaagaaatagaaagctttctactcctttgttctgtttgttatgctgcttcccatgcccagaaaacatgcagggaaccaagataatgcattcccagagctgcctcatcagaaaaatgaaaaagctttaccttgtcttcaaaatggctggtaacagtacagccccaatttattcatttttccttatgcttgttctctcccctaccaggtacacctaaatactgcctcttttttaaaaaaattaaaaatctgcaatccttttaatcctaggagctatactagtttagaagtttaaaataaagatgtaatgaggaatttggtgtcctaacaccatgagtcatagtgatacaatagcaatatcacctttactatgaagaatacctgagaccaagcctaggtaaaggaaattgcaggcctgtattgaacatgcaagtttcaggctatggtttaattagtgagtcaattttctgtctccagtacattggcacacccaaaccttaaagatatgtcacactcattacctagctggaaatcaagacaactgtaggacaaaactaagctgacagtcactagaaaagtgatgatgtctgatcaccagtgacacctcattttccagaccacattctcctacctaggggtacaaatgggatagagtgagacgagggagcaaatagctttacctggcatgtgagatagcaagcataaggaaacaatgatagattaaaactatactcttaccagccattgtgaaagcaaggcagcagacttcatttttctaacgaggtggctccaagaatgcctcatcctagctctctgcgtgttttctaaacataagcagcagaataacaaacagaacaatgaaccagaaaagccttctttttttttaaattttattactatgatactttaagttttagggtacatgtgcacaacatgcaggcttgttacatttgtatacatggggcactgagtagttctatatgatgagtgagagttggtgggaagaatctcgctttttgtattttggcaagaatttgctaatttgaatacatttttccctgacctcaaccatcctgcagaaccatattattcccctgcgtagacgaggaggctggctcagatggtttttggtaacttgcccagtcatcagctagggtgcggcatggccaatgacccctgtgtcaaatctcatgaggaaaatatctccatgggtcatatggcatgctgagtccagttcagaaatgaacccttattattcctgggtggaatttgtgaagaatttcagtctgagatagtggtttagagcaaaaccagtcaggtagaaggcttcttggaaaactggagagcaaatggagctgtgtggcagcaaggcatgagacaagggtgtttcctagattagatggttccagaggccctgaatgagaaataccacatcctgccagcaccacctctcctaaaggtgaagactgagagggcaagaaccagtcagccattggcatccgttgggtagctggctgtgactcctaagtgttttgtataaatatctcatggcctgtatcttttctgtaaacatggatatgcctgtgaagcctctgggcagctggaatcctgtgggaatcctccacttccttggaggctagccattgactgtgaggactaagctctgacgtttttttttatcttgccaattcttatctaaggggtctggggagtcatgccctataaacaatgaattctcatgagatgggttttatttaaccctatatatcgtgacttactttccaacctgactctggcataacattacgagacagggaagaaaataaaaatattttatcccaaaacatgtttctttgccatatcttgaaatggccctgcaaagctgtcctttgtgggggaaatttgcatctgtaaaaaatctctattaacatagctagagctttttcttccaggctctcccaattttaaagagattaactggccgggcacggtggctcacgcctgcaatcccagcactttgggaggccgaggcaggtggatcacaaggtcaggagatcgagaccatcctggctaacatggtgaaaccctgtccctactgaaaatacaaaaattagctgggtgtggtggcgggcgcctgtagtcccagctactcgggaggctgaggcaggagaatggcatgaacctgggaggcggagctttcagtgagccgagatcgcgccactgcactccagcctgggtgagagtgtgagactccatctcaaaaaaaaaaaaaaaaaaaagagattaactaagtgtctagcaccttttattaaagatctgaataggaaacatttgtcatctattgtctctaagggcagccactataagacttcaaataccctgggtctccacaatcttttatcttaacctggacatttcctttctatcaatccaggtctttagacaaactcaaccaattgtaaaccagaaaatgtctaaatttacctatagccttgaaccctgccccctaccccgctttgagttgtcctgcctttctggaccaaaccaatgtatttcttaaatgtatttgattgctgtctcatgcattcctaaaacatataaaaccaagctgcaccctgaccgccttgggcacgtgtcctcagaacctcctgagggccgtttgctgtgtcacgggccatggtcattcacatttggcttaggataaatctcttcaaatattttacagagtttgactctctttgttgactactaggaccagcaacctgggaaagtgatggctcatcagactggactcagctgccaggggagtgggcctgccactgtgagcctatctgagctgggggtgggtcaggggactgagtagctctatatgatgagtgagagttggcgggaagaatctcactttttgtattttggcaagaatttgaaatctcaggggtctgagtcatgctgtagtctcaccacaggcctcaggggagtcaacttctgacctggaggcctggtctgggtttgtggtgtctgagtcatagttcgtgtgataaaagtacgtgctctggtgtggaaagcaggcagaggctttttcactccattctgtctcactgacaatgaaaatgctagctgtgacccaccacatgggtttcatgacccacgaatggaccaggcagctgtttagaaaacactgcggctcaatttctgccctctctgaggggtgttctagaaatctgtatggctgctggattggaaagaaaagagcaattgcatgaggaattgggaagtgaggacaaacagagaagaagcctcagctactatctctaaaatattatctgagaaagaaaacaaacaaacaaacaacaaacacatttcttttcctgaggaaggtgagcctttaaattatcaggcccagagaacatttagaacagaacagcagtcatggctcacttccccttcagctaagtggttacctcttgaagccacttgctatgtggctgtagaataactgaggccaattagccataagatgccatccaccctatagttcaacactgtgtgggcaatcactaaccaatgttatttctgtaaaccaatgaggattcctgacaactctgcaatcgccccatctcctgagttgttcttttttctttaaaaacttgagcctcctttttgttcttggagcactccccatggcaacttagaagtgtgtcctgggctacagtcctcaacctgggcacaaataaactctctatgttaattttgtctcatctttcttttaggtagacacattagctttgggagaatttcaaagagtttgaagttacttagatttgggaaacctgaagggcagtggtgtgtcactatctggtgtggcctggccttcagcctctcagccccttccctccccacctctcagagctcagggccaactgcatctctgaaagagcccaaagaccttgttgaggagcagggggatcctggctgagcctgcaagccctgggtctcttccagactttcctgcctctagcagctgctgctctaggtggccattggtgggctgcatttgctctctgcttgcaaacattgatgacacaggtattttgggtgtggtttagtagtggcccgacacaattttgtttccagtttgtcacactgacaaggttttaacctgacaaatgttaaacacaaattataggaggccattgttttagactaagctcttgcactaggccccaaaagacaagactaaaaataaaaataaagtcacccatgctaacgtttcaggtcaccaaacttactggaaaggcgtcctgatcctgagccctagagaaagttcttggatctcctacaagaaagaatttggggtgagtccacagagaacagtaaaaggaagtttattaagaaaggaagggaataaaagagtggctactccataggcagagcatccccaagggctgctggtgggtattttttatgattactcttgaatatgtgctaagcaaggggtggattattcctgagttttccaagaaaggggtgagttatttggttattcccccttcccttttacaagggaacccttaatcctaagggttgtagagtcaggaaatatgtcagcaggagtcgactcagagactcttcatcttgaataggagctgggtaaaatgaggctgagatctgctggagtgcattcccaggaggttaggcatccttagtcacaggatgaaatagaaggttggcaggtggtatcacaagatacaggttacaaagaccttgctgatgaaacaggatgcagtaaagaagccagccaaaactggccaaaacctgccaaaaaccagcaaggtgaggaaaactacctctggtcttcctcattgctcattattcgctaattacaatgcattctcatgctaaacgacactcctaccagcaccatgacagtttataaataccatggcaacatttagaagttaccctatatgttctaaaaggaagaattcctagaaaactcatgaataatccacccttatttagtatatgatcaagaaataaccataaaaatagccaaccagcagccctagaggctgccctgcccatggaattgccattcttttattcctttactttctcaataagcttgcttctttcactttactctgtggactcaccctggccccgaattctttcttgcacaagatccaagaacattctcttggggtctggattgggacccttttccggtaacaaaactaaaactaagttgttaatctaccttcagagagagagaatagcaacttcctaaccaggccagtttcagtcttcagtctgaggcagcaaaatagggtctggaggcagggaacataaggccgattcacactttagctatgacaggaaatagcctctgcgtaggccaagtaaatgactttgtaactttgcatcatccctttcatttacatagtgtgtgccccaagcggaggacattgaaactccccaaaattctggaatggggcctttgagcccctacgctcaggcccgctcccacactgtggagtgtactttcatttaccttttttttttgagatggcgtctcactgtgtcaccaaggctggaatgcagtggcatgatctcagctcactgcaacctctgccacccaggttcaagtggttctcctgcctcagcctcccaagtagctggaattacaggcacctgccactgtgaccggctaggtttttttttttgttttttttttttttttacttttagtagagacggggtttcaccatcttggttaggctggtcttgaactcctgactttgtaatccacccgcctcggcctcccaaagtgctgggattacaggtgtgagccactgcgcctggccgtactttcattttcaataaaacccttaattccttccttgatttgtttgtgtgtttcactcttgtcacccagtatggagtgcaatggcgcgatctcggctcactgcatccttcgctgggttcaagcaattctcctgcctcggcctgcctagtacctgggattacaggcacgcgacaccacgtccagctaattttttgtatttttagtagtgacggggtttcaccatgttgggcaggctggtctcgaactcctgacctcaggtgatccatccgcctcggccttccaaagtgctgggattacaggcgtgagccaccactcccggcccaaccccatgttttctcaggaactggagttccctttaggaagcaagtaacagaggtgctgggctgcccgggcctctaggtcgtcttctttcccaggctctgtgctctcaccagagtgcgcgttcgggaagcagggagaggaccaggaaagacgcctgagacggagagtgggcaccggccgggggcaggcaggtccggcccctgggggtcagagtgcagcgccggtttgaggcagttcggccacttagctgcgactcgaagtgaatgagtcacttcccctcctcgggcgagctcctggctttgccccagcaagcgggaactcccaggatcaggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccacgtgggtaagaagatttcctctgtagtaggggctgtttaatgagtaacagaactggctgctggttctttacaattgcccagctgctctgcagaggcgagaagcaattgcgggctgagcctcccgggaccttcgcgggagggtggagaggaggaaggcgggggaggcggggccagaggggcagaggaaggtgggggcgggcggggcttgtctgcgggatggcccaggatgcggtcagctgagttcgccggcccagggcaggcggggcccgagcctagcggtaacccccgggcagggcggggccgctcgcagactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtggtgagtcgcccgcggcccggctcccgccgttctctcttcccaggggtctagcccgtcccctgccttggccacgtgcccatttacctgtaggggcggtgacggaggctctggtgcaccttggctgtgagctgcagaggagcagagagcggcccggcgcggctgcgcggggaggcgggcgcgcggccgggaggttctggggctggtgtgtgcggagcgaggtgggcgtgggggaagcgcgcgggcgggatgtgcttcctcgggtccaccccgtgcctacctctcccacgtcccggcgacggagcgcgcggggctctgggcggggagcccaccgggccgaggcgcagcgagggtgaagccagagccggcagggtcaggtcccgcagggcgcaggcgggcgcttctcgcagcccaaacccgggcggggagtgcgggaacccctagaactatgctgggagccccagataagaggaaggagatggtgacttaagtgacgaagtgatgttttgtccccaccgccttttaaagggagaagggggtaaaatttcatttggaggatgattgttacgcgagctttcagagttcagatggcgtcaagtggccatcgagtcaacatttaacaaaatgttaccgcataaaatattgtcatcgagttatctggcagctccgcagagaaacttcacaggcatatgcgttatatgacataatttgcatggggaagggggtcccttcacgattcttttatatggcaacctgttcttggacctggcagggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacggtcagtttcaaagaaacacagtctgggatccggagtagaaagaggccgtttcccgtgaaggccatagaggcagtttccaggcgcctgggtgacctgtctctgcacttccctctctgcttctccatccctgtttcctttccccactgtcccctgcctggcctttctttggctcattttctgccttcctggggtcttctggttaaaaagaccattggttccattcattggctgtaaccgcgggtctttaaaaaactttgtgacttccttgaatagaaagaatgtcttactctggatttctacaagcgctgctgagccattcccagggcaggcctttgtctctcccgcctttcagtttgtttgcccatctgcattttggcccaagctttccccatttctcagctgctcttacattatttcttttttcagaggctaccctgaccttctagtcctctgcattaaacctcatcaccgcagaccgttttaattcagcacaggtgtatcgagcacaaattatattcttggttccaatactttcagcactggtgggcattcatgtttcatttaagaaggataaattagtgtttctttacatgggctttttgtcaaagtggaattttgttgactttactgatcttaaaattaacgcaaacttattgtaaaaacaaacaaacaaaaaaacccaaaaaccaaaaatcaaatatataacagaaaatgaaacttctaggttttcctcttccctaaagataaacaacaaacattcttcttccttctcctctctctctcacacacatttgcttttgaaatatgttcattcaaaaaagtattttaaatgtttacaagctaagttatttatgcaagtaacttaccaatctgatttgagtttaacgggttaaaactaaaaaaaaaaatcaaaaacatcttcagtttttttttttttttaagtaagatggatctggctggtaataggtagagagccccaggtgatcaccgaaaagactcttccttggggagccaaatcctaagccaggtttaggatttccctgggaggtagaatttgcagcccaggtaaaaccagcaaaactctcctgttatgtggggaggggagcgaagagcatggctttctagagaggtgagagaagacttgttgagaaactgaatttcatttccttacggaagttggagaacattgtggtacaatgttaggagaaaggttttctaaaatcagtgcagtctgacatcttcaacaccagggtcttttccactggagcactgcagacatctgcaactttctctgcctacgtgggtgtggttaaatagaccctccctgagtgcagggctgaaaagtggagagaagttagttcttgggacactcacacccaggaggggggatcctgcaggtactaagattgcaaagggaaagagagagtgaggctggtcctggagcccactaggaaggagccagcggaaagcagtgactggacaagggaactgatttctctgctgatgtggccttggtttctctggttcagagtaaagaaaagcaaccaaacctagagagaaacatccttactctacaaggccagacgggaagttctgtctttggcttggtttccttttctacaaacggggttggattctctctggagagctttccgggggccactcagcagtctctgattcagtgggatgttctcagctgctggcccaagggagctcacctcttagctcttcccctgcctggttcactggggggctgctccctcccattagctccctacccctaaagacaaaaatagcagcctggagggggcagagttttaggggaggttgtaagagggcacattcttcagaggagccactcttacgggggaatgttcctgccccacagaaactggccctggggatcaggactctgcctgaccctaaaccctacttcttccctcagtcggtaggtctgcttaatggatcctgaagaaggcctgaaatcatgaccagacccctacgccccgggatcctcctgtagtgccttttgataagaagcactgccctggcttctctctcctccttccacatgtgtagggagaggtagctctgcctattcatgaagcttcatccctacactgtccttcatttggcccctggtgaaccgggggccaaggtgtgatacctcttttaaaactcattcccttcacactggtgttgtgactcatgcctgtaattccagctacttggaggctgaggtgggaggatcacgtgagcccagtaatttgaggcggcagtgagctgtgattgcaccactccactccagcctgggtaacagagtgagaccctgtttgtttcttttttttttttttttgagacagagtcttgctctttcacccaggctggagtgcagtggcatgatctcgactcactacaaccttcatctcctgggttccagcgattctcctgcctcagcctcccgagtagctgggattccaggcatgcgccaccacacccagctacttttttgcatttttagtagagatggagtttcaccatgttggccaggctggtcttgaactcctgacctcaagtgatctggcctcctcggcctcccaaagtgctgagattaggggcgtgggccactgtgcatggccccctgtttctaaaaaaatgaagaataaagtgttgaattaaaaaaaaaatcaacaacaccacaccttattccccttcttagctctccttagctggactgcagtaggctgggatttccaaagaagtgttgtgtaaatgctaagggagaatgaaagcctggtggagagatttaaggcagcaattggagggaacatttttctccacacctaacaactgtagttttccctggcattcaaaatttgctggaaatgatcactatattatggtaataataaatcccattctccaaaaagggaccttttgggttttagcttggtgacaagagactgctgagttacgaaggtgagaaccgtgtggtggaaacaactggcttgacctcaggaaagcagcttcacttcacagactcctactgatgtctttatgagccttggatcatcctgtagacccagtgcttcactctcttcctctcagcatgaatcctgcccactctgcaaggctttccagggagttgggggcctggccattacagggcatttggggatttgtttctttattaactgagttcaaaacgtgagtctcaccctccttcaaagagctctggcaaaaccctgcccttctccacacagagaagtggtcttgggggtttctgactactgagccctagtagaataacttcaggtacgccacgtttttccttcatgggactttgcagtggagacggggccgtgggctgactcaggtcagcctcagtccctctccctcctatggtggtcccctgtccccgctgctccccctggagctgataacttttacccatctttgacccaattcttcctggggagaagagcatctgagattctagaaaagtgaggcagaggccaggcgcagtggctcacacctgtaatcccagcactttgggaggccgaggctggtggatcacctggggtcagcagttcgagaacagcctgcccaacatggtgaaaccctgtctctactaaaaatacaaaaattagctgaacatggtggcgtgtgtctgtagtctcagctactcgggaggctgaggcagaagaattgcctgaacctgggaggcggaggttgcagtgagccgagatggcaccactgcactccagcctgggtgacagagcgagactgtctctattaaaaaaagggaggcagagaggtgtggtgtgttgggtcagtgagtcttgacttgctgagctgggaaattgggaataagggacaggtttttgttttgttttgttttgttttttgagacggagtgtcgctctgcaacctctgcctcccaggttcaagcgattgtcctccctcagcctcctgagagtagctgggattacaggcgcctgccaccacacctggctaatttttgtatttttagtagagatggtgtttcactgtattggacaggcttgtcttgaactcatgatctccacccaccttggcctcccaaagtgctgggtttacaggcataaaggggacaggttctctggaggtgtgaggtgcctgtccacttaggcttttggcacattttcagcacctcctctctgaaactagcaatgctataaacacacatacacactctcctctctctctgtttctatttctcacacaattcacacacttacatcaggtgtgtaaggaattccacttcattgcactgactttctacatattagtggggctctgcacgatcttggtttctactgagtggattcactccattctgtgattttttttccttagggtcctgcctcagttggcggaatggcggccacgggagccaatgcagagaaagctgaaagtcacaagtaaggctccatttcattccaggttgggttgggtggggttgggttgtttatagagcatatgttgtgccacacatttttctaaggacttgacatatattaacacatttgatgcttgtgaaagagactgaggcctggagggattaatgactcaggaggttcgtacattagatggttaaagacctccggggtcgggtgctggggcctcagctcttgattcttaggacatgttgtttcagaaaaccagacaagtccctgctcaaatctctgtctagtaggtttttcctctatgtgccaatttcttaaacaaaatcccctgcttatcactcagctctgccttggttctgaattttaaatgccttcttatttctttgcagtttgtcatacttctggtatgcttggcatgacaccacttgtgtttaggcattgctagaaaagcaagaatttcttgtcttcattctgattcctatgtgaactttaatccgctgattattcttattttctcacccccccagttgtctcccacctctgctggggttacctgggcaggccttctgtcctgccgccatggcctctccccagtcttggtggcctctgaccttggcaccacccagggttgtggtgacctctggccccccttgctctggactcctggtcctttgttcctctgtaacttccctgagacctctctgaagtctcacatgtgacagctgcatacccaggtcataattccatatggacaatgctcttctcctcctccattccccagaagtcctggtgtccattttggagtttctggtgcctgtggacattccctgcagtgattttttttttttgagatggagttttgctcttgtcgcccaggctggagtgcagtgagtggcgcaatctcagcttgctgcaacctctgcttcccagtttcaagcaattctggtgcctcggcctcccaggtagctgggattacaggtgcaagccagcacacttggctaattttgtatttttagtagagatggggtttcaccatgttggccaggctggtctcaaactcctgacctcaagtgatccacccgcctcagtctcccaaagtgctgggattacgggcgtgagccactgtggcctgcctcagtgattattttttaattgaactaatagtattcctggtattttcagtcattgacagccaaaaatgccttgtccccagtttctggagctcccctccttcctcctcctgccatggcttgaggttgaggcctagtaggaggctggtgggggtggaggggagtggtagaaatgaaggctggagaaaacagggccggcacaccaagtgccaagcaactcagtgagggtttcctccccttccctctcttcagtaattattttaccctcccttgttttatcctcagctatctgctaatcatgttccacttgctgaaaggcagtcaggtgtagagctcaggagtacagcctcttaggaaggatgtgaccttggactttgaatggggttactgatggtacttagtttatactgagagtattaaatgaattgatatgtgctagctattaataacttcatttctaccccaagtcgaaagccttccatgagtggaactggatcttactcatctttatgttcagtacacccagcacaggatgcttggctgttgcgagatgcagccagcattttctggagccctcccacttccccttccccagtacctcaggcccctgtgtctcacccatctcattttcttcttgtctccacatgtgctggtcctaagctatttgggcaagtttatataaaggttgatactgctttctcttccctgctgataaactcctggaatcagaagccagttttcattgctttcttttttttcctttttgtcttttattgagacagggtttcgcccttttacctaggctggagtgccgaggtgtgatctcagctcactgcaacctctgcctcctgggctcaagtgatcctctcacttcagcctcctgagtagctgggactacaggcatgcaccaccacacccagctaatttttgtatttttcacagagacagggtttcactgtgttgtccaagctgatctcaaactcctgggctcaagtgatctgcccgcctcagcctcccaaattgctgggattacaggcatgagccaccgcgcccagacagttttcatttcatttcatatatttcttttacatggtagatgctcaatgaatatttgctagatgaataaagtggtagaataaagcagaataaagtcacttgaaattatgtgtagactagagaaatatttttttccaggtagtatgtctctgacttgttattttaaaatccttcaaaaaataaattggggcatctactggttcattatggtacatgttaaatttactttttaaattttactttattttttatttttagacagtcttactctgttacctaggctggagtgcagtggtgtgatcagggctcactgcagcctcaacctcctgggctcaggtgatcctcccacatcagcctcccagggaggtgggactataggtgcatgccaccatgcctggctaatttttacattttctgtagagtcagggtttcaccatgttgccctggctagtctcgaattcctgggctcaagtgatccacctgcgttggcctcctaaagtactgggattacaggagtgagccactgtacccggccaaattttcatgttttaaaataattgcctgtcttcacggttacaccctacttccttcttcttcatttctcagaatcaaggagaaaagacaagtattttattttgaaatatgtgacaaagttgtcttaatcacatcctgttttgttattttgaagcatgactcttagcccttctatgttgtactctgtgtatttctaacatcctgaaggaggagaatggaaatgttacttacatgaaaaatagttgtcactaaaggatcctaaaatactgtggggtgtgcagatcgtcagaatttcagattggcctagagatcaaaaaggttttctgagaaaagttcaaggatggtccttaccacacgtgattctggatttggtcgcttgaaaaatggccttgccccacatcccagagtagaatgaaccctgattctggagatccccccaatagcttgtcaggaagaggtgggcttaggggcaggcgggtgtggctctgtgcttcaggcaggctgctgtgccttcctgagcagggttttcagcagattcactagtgcagtcagcagagtccctgcctgcccatacaggagacagtcacctagccccctgtccccttatacaaagatctccctgtctctgtgtataaccctttgtacttatgttttctatatcagcctttctgaaatgttcaggtgtgagctcacctgggccccactctaggggaattgatgggaaggaacatttgacagtcatgaaaggaggaagcagtcaggtataggccatctgtgtgtttggagcctgggtgtctgctgttgatgagtgccagatagaaatagggatttgataaaatgatagataaaataggatgggaccatctcaaccttgtttttcttgtctgtggtgtgttacgtgggattcagagatatataagacgtggtcatggcctccagaaatttttgttctggaggtaaagttattacattaattatgtataccagtgttaaaatatagataaggtgtaacaagcatcgtgtggggagagaatggacaatgtctgtgaggggggtgcatcccttatttaacagttatttccaaatccgtggcagctgagaccttgcctctcttgtgtctttttcttttctcatgagttagaatgaggaggagacatgaccacggggttcagggcagaaagtcagactcagaaggaagaaaaagaagtccccaattgctctgacatcagcatcccatgtctgcctctgtttcctgtaagggagcccacccatctctaggactcagaaggcatacattgttgaaggagctacgtttgaggctggctctaagggacttcgacaggcttgagggactcatctagacctggggcatttgttttgtaaggaaggttttattggaacacagacacactcactcatttgtgtgctatctgtagttgctttcacatgtctacggtggacttgagaagtagcagaaatcatgcagcctgcaaaaccacatgtatttattatctggccttttatgaagaaaagtttgctgatgcttgctctagaccagcatgtgccacgagcacattttctagcagataaacagatgtcttatcttgtcactcctattggatatcgtgctggagaagtggtagctagtgtaacaaaaacaaaaacaaattgaaggtatgcagattggaaaggttatctctgggaggtaggattagaggttgtttttccttctatttctgttcatatttcctatggtaaacatagtagttttaaaataaattcaagtttatacatcgaatgaacttgattagaggagcaactggctatactccctactccttgtatgggtagatcaaacatttccatctgtgtactttcgtgtgctcttctgatttcatccctgttgccctccaaacagagccatgggagcaacaggggttaagagggaggagaagggggaagaacagaggggaggcaagtgcggaccttggcaatgttggggttgtcttatctccgggatctggccctgtctttctcccaccatgagcctcgtgtctgacataggccacttctgtgataatgtcggctgtcgggcactgatgttctataagccttccactttcttgttttttaacagtgattgccccgtcagacttttaaatccaaacatagcaaaaatgaaagaagatattctctatcatttcaatctcaccactagcagacacaatttcccagccttgtttggagatgtgaaggtaagaggccaggtgttgacaccttggaatttgccttaagatcaacctccccctatattatacaggtagaccaacccacaaatgcttgagagaccacagctgacaggtttatgaagacataatgtttaccaaatttttgcaagtttttaactttcaagtatgtgaactagcaagtaaaactatcctaagtagtgccaaattgttccctaattcatcttttgcaaatttagtgcagtcatgcattgtttaactctggaaatacggtccgagaaatgcagccttaggtatttcatcattgtgtggacaacatagagcgtaaccacacaaacctaggtggtagagcctactacttgcctgggccatatgcctctaggctacaaacctctatagcatgtgagtgtcctgaatactgtaggcagttgtaacacagtggtaagcatttgtgtatctatacatatctaaacatagaaaagctacagtaaaatcatggtattatataattttctgggaccgctgttgtgtatatgtgattccttgcttaccaaaacatcgttacatggggcatgactatgcatttgaaactatatataaaataaacttcctaatgcttcattgagagaagagaaagatgtaaaaatttcctagggaagcaaaggatagtaaataaaggtcattgtattttgtttgtaatataagatacatattgatattctgtttagttaattgcctttaatgtcttattttgcttcatgcagcttccagttaactttttctacaaagtcttaagtcccttagttctgatttatcttaacgtaggactttgaaatgtctaatgggtaaagatgaactgacatgtagaattaaaaatcaaaatataccaggacgctagaatccagtgctgctacatgggatcataattaaacaatagtgttatgtcttatcaatcatcctgttctttgatagtgttggtttcaaatggtggacaacttcccatgtgcttttaattcattaaaatttcattcatcctattaagttaatccgtagtgatttttattccaggctatggaattttcttttttatgtttagagaataattaataattcttttcttttatcttcagacttttttttttaaattttttgacctggagtctcactgcccaggctggattacagtggtgtgatctcagctcactgcaacctccctgtcctgggttcaagcgattctcttgcctcagcctcctgagtagctgggattgtaggcacctgccaccatgcccagctaatttttgtattttttagtagagatggggttttaccatgttggacaggctggtctggaacgcctgacctcaggtgatctgcctgcccactcccaaagtgctgggattacaggtgtgagccactgtgcccagccatcttcaaactctttaaaaacttactcacttaaaaaaattttttttttcaaaaccaacattttcttacatgatgttctgcaaattaaagtttttacttctctgagagagacccatccagaatagctatcacttcctgagcctcctctaggcttcggctggctcttctcaagcattggctatttggcactcaagtaaccaggcgagagagcggtcagtagcccattttgtggggccctggtaacacagagggacagtgaggagttgctccctctgtttcaaacccaggctgtctccacaggccgccttctacatgacggagggaggccgagggtgcacaggacctggaattacctcctcagagagagcaagggtctggattcctgcgtttgtggagctgactgccttttgatgcttggccgcccaccctgaccactcaccagggggccttgttaaagcagattcctgggccccttagattcagcaggtcctggtgaggccagtgaacttatatttttagcaagttcattggtaatactgatgttgctggtctaggggccccacttgaggacctctgctatagacagtgcactaatgggggtctctcttctctggctgcagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtgtgagtacctgccttcccttgtgctcagtctctaggctctgcaaccccctgtgccccacccctctgcacacacagacagctggtcccctaacacctgcttactgtaaatggctgggagcagggtgagcccacagtagctgggattcagagattattgaactcaggctatcgtccttgaggctcagtctccaggggcgactaagtacacaaatgcatatacaccgctgtctgtctacacagtgtgagggtggcaggtgcagggagttagagtgcttggggtgtagaggaaggacagtagggggcgccctgcctggagcaggatggaaggagagcctcaaagtaccaggcctctaatcccctctaccacctcacagtgagttacttcaaaacacattttgatttagcaaggagcatggtgaacacagaaatctccagattctaccatagaagtcttttcatttttcagttttgattttgtcaggagcaatataaatgaacagctgcagagtaaggaaagggaaccccttttgttgagatgtgcacccctacctctccagtcagctgaggacactagctatgtcaaccaactagaacatatcagggagccaagacatgactaggttactgataatctgcgcaagcctttcctgtgtgtaaggctccgtgaccgattctagcagggatgcctccactgtatggctctgccacaggaacagcccctggaaagtgctgagttcatccggggagaggcatcacagaagttgtgacactagggggggtgctctgaagaggagagcaggagaaggaggtatgcagagaccccaaagagaggaaaaggcacaggcagacaagatcagcaaagcatcctgtgtccagtgggctgaggaaccagctgattacttagtttgtctgaagcagagggtgtagggagaaaagagaaaggagataaaactttaacctgtggtggggtgtgggagaatagggtgggtatttatgcagggcttcaaatgctagaaggagctgtttgttacctggcaatagcagactgctgcttccctgctgagcccctgggtccgcagctgttacctatttgacaaattgtgtcgatcaaatggggttttgtctttgacagctttgcatacactttaaagtttcccaaagtgttactagttcttaaatttatatttaaaaagtttatctttcatcactatgtcaatgggcatgttagattgaattacatcacatgaaacatcagccagaacattgacaaagtcacaaccttggcttaacatgggtgtttctccctggttccagcatggtatgggcattccttctatctcaatcatgttgcatgagctcataaagctgctgtactatgcccggtgctccaacgtcactatcatccgcattggcacttctggtgggataggtaaggtctgcagaggggcctcttgccctgtgaatggatgagggactggggcatgccaaggcagcttctacatggtgtggcattagagacaaagagttcctttcttggctttgttcaagggaagcttgttaacaggaggtgtgaaaagaagcttgttttgttgtttttgtccaacctgttctcccaacccgcaccccagagctaggcagtagaagggcaccacaccatgcatatgggggaaactcatccttttggggttacacaatttgtgccttcttgtctgcttgattctgtcttattctttctaatcccccttcttctccattctctcctttcctttgcttacttttcctcctccctaatcctgcagggattttgaagcaccttaggagaaaagacacaggaaaatcaaaggggggaagagagaggcgcagtacaaaactcagataagtgtccttaaattagcttaaaatgtccctatcctcaacagggacattttttttttgtttaaaaaacaaagatggttggccgggcgcggtggctcacacctgtaatcccagcacattgggaggccgaggcgggcggatcacaagatcgggagatcgagaccatcctggccaacatggtgaaaccccgtctctactaaaatacaaaagattagctgggcgtggtggtgcacgtctgtagtcccagctgctggtgaggctgaggcaggagaatcgcttgaacccgggaggcggaggttgcagtgagccaacatcgcgccactgcacttcagcctggcaacagagcgagactccatctcaacaacaacaacaacaaacaaacaaacaaaaacccccacaaacatggcaaagaaagaatgagatttaatgagaaagcaaaagctaacaaattgttgaattgtaagccaaagtctgttaggcagatttgttttaaatacgtggtcttgctctctggggttccaactctgtgccattctttctgctaaaaactgggttctagtgattcctgctcccaccgaggtgttcagagctcagggaagaagcctgcatgtgccctagagaaagttgagctttgccgctgctggccaggcctgtgtgtacttgttccaggctgtctagggcctggactatctaggatttatagcaattctagaatttaagtgtcctgaccttgaaaggggacttgctttagacccaaatattttgaatatgttatcttgtctcttttctttttgttatatagagagattgatgcataaaatctgtgtttgtatgactgtaattccaagtttagcgaaattgtccctaggacaacacaccaacggccatgagctgtctcggtcctgcaagcttagtctccgatgctgcccacctgacacagctgtgcatagcatgctggcctctgccaggaactctagtgaatggttcttgagttcttgctctggagtgatttttaaaacaatgatcagataattctggagggagtagtatagattttgaattttcctcaattgctctgtaaaaatggaaagagcaactagggagcaaaaccaaaaaccactggacacagttgataataaaaggtgatgtgctatcctcacaaaccccaaagtatgaatgggtggagacaaaaagcctcaggatctggttgtgttggcagctgctcagggggaagctcaaggcgatggacagacctgagaacaagagtcccaggcactcctaggaaggtgcagggggacatggtgaagatggcagctgacactggagggggcctgtgcgtcccaatgtgagtgatgctggaattccaaggggcttgaccactccaggccctgtgggttcaccaaggcatcagccaagctctcctctagctccagccccagtgctgggagaagctgctgaaatgagactctgaattgcccagaacagccgcaggagtagcaatggaaagaggagttcagatacatgtggggagcgaagcaaaggtctttgcaatcggccatgttttttaatgtttcatgaaaacaactgacttgggagctctggaaaagatctgacttcttgttccctcccacatgtttaggaaaaccaattttgcattaaaataagtatcagaaatggatcatagttatcttagtccctgcaggttgatagacaagatgccattgactgagtggcttataaacaataggaatttatcgcgtagtctggaggctgcgaagtccaaggtcaaggagtcagcaaacttggtgtctggtgagggctaactttcggattcatagagctctgttttctccctgtgtgctcacatggcagaaggggcaggcagctctccggggtccctcttataagggcactaatcccactcatgcaggctccaccctcatgacctaatcacctcccaaaggccctgctgcctgaaaccatcacatttagggttaggatttcagcctatgaattttgagggggaaaccagcattcagtccaggtccataacaatggtcaaatcccatctaaaattattataacacaaagaataaggggcagagtaatgtccctacaaacaggaaactactccaggaaggcacgcccagaacatagaaactggaccctaataatgcatcaatctgagaggaaggccaggtaggtcaggagttggtcatagctcacctgggtttagggtgtgggacttcattatactgttctagtctgccttttgctggtttacttttcaagtatttgcctgaaatcttaaatattaacaaggtatgaaacagggatcaatgaaacacatcatggtatatggttcagtgacagacaacagtgggaaatcgccgtgaatggaagcaagaaatatgggacaaagtacttgaaggttcctggccatttttattttattcttttttttttctttcgaaatggagtttgctctttttgcccatgctggagtgcagtggcgtgatcttggctcactgcaacctctgcctcctgggttcaagtgattctcccgcctcagtctcccaagtagctgggattacagacacccggcacaatgcctggctaatttttgtatttttagtagagatggggtctcaccatgttggccaggctggtcttgaactcctgacctcaggtgatctgctcgtcttggcctcccaaagtgcttgggattacaggcgtgggccactgcacccagccctctactttgttttttgtgcctttctcttccatagtgtccataatgatcatgcattaattactttcatagcttaaaaaaaagttgaatgggaaaaatgggtcactgtgtatttgagaacagtactggatgcttcgtgtttggatgtgtgggtggatctgcttctttcttccatatgctctgctgtgtgctccctggctgccctgctttaattttattttgttttacaccctgcatatcttgatgtctgcttttttcctcaggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaaggtgaggcagcggatacgaggaggcatctttcagccagggaaccctggtccgtcccctgagcctgccttctcgctgtggactggcgtttccacttgccaggctgctgtctcagttacacttcgcccagagtggttataatgacccgtttgagtggtcattataggcaggacctggatgggtcttgcttgtccctgtgtccttctgggcatcagtggcgctgatgtgttgtaggagcttctcacatgcatgtggttctcatgtctccatgtgtgcctcagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaaggtaagcggcacttgatgggcctcggcgtcccctcctcccttcacttctgctctcctggagcccctcgctggggcccctcctcctggggcaccccgatacccatttctggtttctgtttccgctgcccccaagtcactttctgacatatgtgttgtcaccacaatgctgttcaatgtctgactgtcacaccctgacaaaatgcaggattctcagtgaccttgtgcaggaaaaatgacaaaaaagcttttgctgccccatgaggctgccaccaggtctataaaaaactcggctttcaaagcgctttggctttctgaattgtggttcatctaccctcaaggtactagccacccttgaaggccagctcacagctctgcagaattcccttatcacctcggccaaaacgtgcctttcaaggtggtgcttgcagccctgagctggtcctggaatggtgaattccttttggaagcaggcacgagaataagggagggacagggcagggtggtgtcagagagggaggagtcttccgagcccctggaccagcgcctttccctcccgcactccatcctccggccccgcctgactgcatgggcagcctggtttcctgaggaggcagagaggctgctcctcagagctcgtgggttcttcatcccgtccctgtgaaatgttagacccccggcaccttgccttgatgtggtctttgtcctttgcagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacattaaaaaaattccatgcaccacttgcaatgagagatgactgaaaaccaatgaagcagacagcaggggtgtttgagaaataatgcgtacctaaacaggcatatacacagtttccaaattatagtcacacacattcccaaaaccatccacaccagcttaatcacacgacagtaatcctcccacccattgtccacaatgctagtgtcttgatccaagtacctagggatgggaaacgggacacctgggctcaagacagcttgtcctattgtttctgtccatggcttgtcagccttgcattcattcctggcctcacactgacattcctagactccgtgtctcttagcttccttctcggttgcaccttatagtggaggggagaatccagggtggcccctctgtctgtctcgggtgagtctggcagcagctacttgggcaggcctaggtccccagctcaggggcagctgggtcttgggtcttcactggcttgtgggttgcccaggctcctggctgacttctcaactctccccacatcagtgtggccactttctggtatttattgtttcctgtccttgagatgggcttatttcctggtgggctctgagggacactcccatgctcaggggctctgcttagcagtttgctgtgtgacttggagtggccagggaggtgtgtggggaccttggtgtgggtgcatgtgtgtggtctgtgcactctttaatgtgccttccctgtgattctgagattcaacccaaaatgagggtcattcagcatctactgagcccacatgcccttctaagtgctaagagcaagagagatccttgtcccaatcaaaaacttccttcccttccaccttctcaagctctagggtctgtaatacagatttgcttagggtggagagtgagtctccttccatttctccctcagcacttcttggtccctttgttgaagctgtccaggagaaattggaaccctcaaggagacttcagggtcctgggatgtggctgtgcagtcatctgtgcacccagggcagcatgctaaaggctctgctcctggcttctcactccagcacgagctgcaggggctggacttgctactattgtgcgctcatctgtctccaaattaccaagtgcccccagacttcaactggatgtcaccatgcccctgtgggtgcaggacccagtgtgggatagcctttctatcctctgaccaaccagatgatgtttatcaccaggctctggggcaggctgaggatgcaggtgcggaccattgccccaggcagtaggggacttgcaggttaatttctttcacacctcaacccaggcaagtgtggccaggtgggcccgccacttcctaggaggacatctttgataaagcagagaaaaaaaaccacacagaaatagaatttaaggctaaagaggaggctgctattagtaagaaaagggctagtttgtttttgaggtgttttgtctctgcactgcctggaagtctgtctcgctgggggagctgtcacagagcctgtggcctgagcaccctcctccgggacaaggcagaaggtaaaatgacttctgaacatgagattctttctacaggtgtcaatggccaagctgcagctattggcactgcactgccctctgctggctatgtgaggtagtgcacatcagccacccccaggtggatctctgttgatctaatcgggcgacatccctgaccttacaggtgaactctataccccctgacacgcaggaaatgccggttgaacaacacatcttgttctgattgagtaaacatgaacttgttggattagtttatgtcggcctaaaaggaagaagctgaggcaaaattggtaaaagtagagaagtaactgggtccaagcttgaagactgcaacccaagaacatagattcaagttcccctgaatgaacactctgattagcagcacttacaagtggatttttaaaggtaaaagggacagggaatgggctgatacacagctgtctgccaggaattctcattggtttacagaaatgatattgatcaatggctacacattgttaagccatagagtgtgggttctagtattcagtgtggcattattaagttaatttatagctacttgtggcaatagcaagcagttccaagagatgaatacatagttaaaaagggggagtgattgatgtctttttcttgagacaaggtcttgctctgtcacccaggctggagtgcagtggtgcaatcacagctcactgcagccttgacctcctgggctcaagcaatcctcccacctcatccttctgagtggctgggaatacaggtgcacgccaccacaacctggctaatttttgtatttttttgcagagatggggtcttgtgtgttgcccgggctggtcttgacctcctaggttcaagcgcccctcccacctaggcttcccaaagcattgtgattagagacgtgagccactgtgtttggcttattgtcccattttaatgtctctctggctgtaataatttgaaaggtctcaaattcctcagatgaaagttattttctttcctcatttggctaccaagatgtctctggagctgacgttataaatgtcctcacatgagtgttacttgaattcctcgggagacgaccagaaacttggtccccttcctcaccccgcactggccactctttgactttcaggcccttgtgccacgctggtatcattggcttggtccccttgtgggggcttcccacaacctgggcactggccccttcctcaacccctcctccattcccagcgctggtgataaagactcttctgagcaggaatataatgacaccaacatggttcactttcggtgctttcagcaaggcagagagaattaggaatgtaattgggattgttctgatggaactaattaccctggatttcaaaaatcgttgtcagcgagttcactccatgttttcctctagtgcagtccttaagtgatatgctcagaatgcctcccactaatgtgaaaaaaaaatgttaataattatccagccctttgtaaattggaaaatcagcacgtcactagtgagttagtcaagagtttacctcaggaagcctgccacgctctcacataaaaggttgggctttggtgtcaattgcagaggtggccacgctcctcctgctgcctcctcgcggtccagtctcatcacagcggtgacaatgccaccttgaccagaaacaatgagatgatggtttgtctttataaatgacaatagggacagtggaatatgttagagcatgagctgtgcgtctcctatacctttatccttaagcctagcactaagccacgttttaaagccaggtgtccatcatatattgtattatccggtaattccactcctgctcctgggcttgcatggagagaactcatgtggcccaggaaacatggacaggaatgttcataattgcaaaggcctcggtaacaaaagccagaagtccccaaatatccatgtgccagagaacaaatgcaatgagtttggtgtgctcagatgatgaaaaacagtgaaaataaatgcagacaccttcaccatcagtacagaaccatctcaggtaacattctaagtgaaaaaagcaaattgtagaatagtacctacaacatgattccatttatataaagtttgaaaatggacaaaactaaacaatatgttgtttaggattacgtgcatttcattgtaagactaggggaaaaaactccaccagggattgagaaaccccaattgagatcaggagtttcctctgttgggaggcagggtgcatttgggaggaggggggacccccaaggacatcaaagatgttctgtttcctaggttaggaatgactttcacatcagggcttctgggttccattgcagcttactcatatttcagtactccttggtatgtatgtaatagtagaatatcatctcattaatcaccacccagacattaggctcaacttataaaataaggaagcagtgctagtataagaaaatagtactgctctgctggtgcttagtagtttttcagttaccacgtacatgaaggagagtgatttctgaccgattttcatggagtaggatcagctctgcagatgtgagcttttaataatagctaatatgtattgagccatcgttgtcaggccccttgtgtggaacttccatcagcgatcctgcctggccctctccccatctgtgttatccccaaatgccagatgaggacacagcctgggctcaggtctgtgtgagggttgggactgtgcggccacagtgtgttattcacatatgtgcacacatacacacctgtgcgtttccatgcacattcatgcacacattgtcatacatgcacagccatgcagaagtttacttactaggaaaagagtagcactcagttctctggacttcacaaggagaggagaacacaggtatgaatgtcagtccttggcatcccagcgtagtctgtgctgcggtggggtggggtgggggctggtaagagttctcctttagggtctctttcagtgaatgttttgtaggaagaaaattttaaaaagggtaaaatcatgactgccatacagaaatgaaatgaacatgtgtgttatggaaataaagccaacccgccagtggtaggcctttccatgtccagtctaggagagagaaagccccagttatgtgtgctgagactccacgcgtgtgggaggggactatgtggagggagtcttacattacacagtgaagtggaggaaaaatgagaacttcccccagatctccttgaagggtgactggatgatcttgtgacagtccctgcgtgcctcccgagggtgcctgagttatttgggtgcatgtgttcccagttctagggggcagaaggccctagaccttgctttataaaatcaaaatctctcacccggctgattctggaggcactctaaggagggaggagggaagcaactacctcccacaagaaaggttcatcattttatccttacacatggaaaatactttttttttttttgagacagtcttattctgtcatccaggctagagtgcagtggtgctatctcagctcagtgcaaattctgcctcccaggttcaagctattctcctgcctcaacctcctgagagctgggactacagtcatgtaccaccacgccaggctaatttttgtaattttagtagagatgaggtttggccacgtgggccaggctggtctggaactcctgacctcaagtgatccacccgcgtgacctgcccacctcggcctcccaaagttctgggattataggcatgagctgctgaattgcactcaccatgagggaagctggcaggtgctgtgactggttctcagaggcagtcccagtggcaggagttcacacggagtgaggagcatgaagtacagatggaagcagagccagcctctcagcagggcccacaggggcagtcaagcctctccaggcaggacagaagttctctacaattcccagggttgcaaatagctcctgtggaagggacgccagaagccctgcagaggcaccttgcagagtctggacaaggcagggttccctgcagggccccacggcttccctccagtgtgccgcggccagaggcaaaaggacgtggtggtggactgccttgctggcaggttcccaggcctgtctgggcaggttcctcccttcactgaacagcagtttcctttcctacgaaattccatgtaccacacagggctcttgtgacgatgggatgaggtcacaggtagagaagcacgggtgcgaggggctcatgaacagatttaaactcttccccagatagctgagcttggtgccatttgccctggggcctctttctggctcacattttcctcctgtggcagtagttccctgaggccaatccagtctcacctcaaccttaaacacccctccttgtgcccggccagttgtcacttgttatctgagggctgcacccctgcatccctgccctccttctcactgaggacacagcgggtcccctctttctagtcccacgcaaggatcactcctcggggctagctctgggctttggttcacgtgccccacacccagtccacgccaggctggcctctggaaggtgagcttctcactggggacaggatacagggtagtgtggcccaggaaggacatctggtcggggggctgaggagagggaggtggaggttgggagagaggcaggacaggcaggatggaaactgtgtttgtccatttgcactgctatacagaaatacatgagactgagtcacttataaaggaaagaggcttaattggctcatggttctgcagacggtgcaggaagcatggccctggcatctgcttctggtgaggcttacaattatggcggaagggaaggggagcaggtgtgtcacatggggagagaaggagcaagagagacgggagcaagtcccagattcttttaaaccaccagatctcatgtgaactcactcatcaccaaggggagggcaccaagctattcatgaggggttcactcaacacctcccaccaggcccacctttaacactgggaataacattcaacatgagatttggaggggacaatcatccaaactataccaggaacagtacttggggatggttcgtatgtgtgtgtgtgtgtggttttgtgtgtgtgtgtgtctgtgtgtgtttgtgtgtgtgtctgtgtgtgtgatcaaggtgtgggcagaactggttccttttgaggcctctctcctgggcttgcaaatggctgccttcttgctgtgttctctgttgtcttccctctgtacgtgtctgtgtcctaatctcctttcttataaggacaccaggcatattggatcaggcccaacacaatgactctgtttattcattcattcatttattttaaaaaatagagatggggtctcagtatgttgcccaggctggtcttgaactcctggcctcaagtgatcctcctgccccagcctctcaaagtggtgaaattacaggcatgagccaccaagcccagccccaatgactccatttaaatgtaatcacttctttaaatactccaggtagaccacagttgcattctgaggtcctaggtgttagcacttcaatacatgacttttgaggaaaaacaattcagcttataaccagaaggagctggcgtgagggccttgtgaaaacagaggcacataaatattaatggtgttgatctactgtcttggatgtaatacagatacatccagccctagtcccaaaacaaatgaccttcagtcagaggtaattttttaagtgtgcatttccataggagcaaccaatgtgtaagagcaggttgctcaaaattaatctggttttaaaaaattctacccactttgcttttcaactagaacatcatgatccttccatatcacctttccactaactgtgttgctgccacttaccaggccacctgtggggactggtcaccagtggacacacggccgagattgcctgtgtggactggtcaccggtggatgcagggctgtgattccccctgtgtgggctggtcactggtggacacagggctgtgattctcagtgtggactggtcaccagtggatgtagggctgtgattccccctgtgtgggctggtcactggtggacacagagctgcgattccccatgtgtgggttgatcactgttggacacggtgctgtgattctccttgtgtggactgatcaccagtggatgtgggactgcgattctccctgtgtggactagtcaatggtggatatgggcctgtgattccccctgtgtgggctggtcaccagtggatgtagggctgtgattccccctgtgtgggctggtcactggtggacacggggctgcgattccccgtgtgtgggctgatcactgttggacgcggtgctgtgattctccctgtgaggactggtcaccagtggacgtgggacttcaattccccctgtgtgggctggtcactggtggacatggggctgtgattattcctgtgtaggctggtcactggtggacgtggggttgcgattcccactgcgtgggctcgtcactggtggatgtggggctgtgattccagtgctgggtaagcagatgcttagagagcttcagaccctggcacgggtgatgaagaatgacaatatggcagaagacgagagagggttcttttgggagtggctactttagaatgattgttgggggttatgatacccacttggttgttgggggaacaggaacaggaagtctgtggctccagcagaggaacttgccagatacatgccagaggaatgaacgtggcatgtgagaagattccagtgaaggggactagtggtgtggcatacaaggtggctctgagctgctgagagcagattacacagattcctgtagatcacacgtgtccctgtagaccacacaggttcctatagacagaacaggtccctgtagaccacacaggtccccataaaccatacaggtccctttagacaggataggtcactctagagcacacaagtctctgtagaccacattttctttttttttttttttaagttcactgaaaaatgcatgctacaaatataaccaaattttatagcaggaggaaataagtgaaaccaagtaaaaccaattataataaaattgagaaaatatgggcagccaaaataatggaaaatagcatttttcatggtgctgtcacatttttcattgcaaatctaagaactaaatcaatgtcgaagcaatcacgtttatgagatttccatcaagttatatttattcatcttattcttcaaattgaaactttattacagtttagattagaaagcaaaacttgctaatatttttatgtgtattaaagcaaatttgacaacaatgtttcatattctgtaacttggctttggtcgttattttgaaaatgactttccatgtttttcttacagggcccaaaaggtaatcctggcccagtggtatggatgtctccatgttttctgtcatttaggatataggtctttgaaagaaaagaatcaggaagatggcctgctttcttaggtgttcatcagttaacatgtttgaggtgacaagcaggccaccaaagaaatgccaacatccatctttccctccctccctccctcccttccttccttctttccttttttttctttcattttttgagacagagtctcactctgttgcccaggctggagtgcagtgacgtgatctcggctcactgcaacctctccctcctgggttcaagtgattctcctgtctcagcctcccgagtagctaggattacaggcacgcaccaccatgcccagctaatttttgtattttcagtagagacgaggtttcaccatgttggccaggctggtcttgaactcctgacctcatgatccgcctgcctcggcctctcaaagtgctgggattacagacgtgagccaccacacccggcctgttctttatttttaagaggcattagagctgatgttgtcactgcccttgaggttcgcctcttcccatcagtgtgtttaaatcatcctgcgttggaggacggcgcacagaaagctctgataaatgggacggtttcttttaatagctctcttgatgattgattctattttaagtagattgtgggagataaatactgactggagagaaattccttcacatatctgccacctcccaaacaaaaaagaaaggaactgtttctctgctttaaaccagaccacattttcttcatccaatctgctgttgaggggcaccttggttgactccatgtctttgctattgtgaatagtgttgtgatgaacatacgagtgcatgtgtctttttggcagaacaatttattttcctttgggtgtatacccagtaatgggattgctataggttaaatggtagtaggacataggaatctttcgatttctatctctttggaaatctgtttcctgatataaaggagcaaattgaagataatgtaattggatacaggtcagccctttgatatcacttgggctgcaatccagttctttgaggaattacaaacaactgtccttgtcttataaattgagcctttacaaaaacaaaaatgtgactctggaagcaattcaaaactcatccatcctacttcccaaccctcaaacctcctctattcacctggagatgcatcaggtactgtacagtcaggacactgaaaatgtaggcatcctgcatctaagaaaagaggaagaagtttaaatagtcataacctaaaactctgatcataggcaaatgtgctccagaactctttgtttttgccttttcttttttttccccatacgttattggggtacaggtgatgtttggttacataagttctttagtggtgatttgtgagattatggtgcagccatcacctgagcagtatacattgtaccctatgtgtagtctttcaactctcgctcccctccaatccttccccgcaagtccccaaagtctgctgtatcattcttatgcctttgtgtcctcaaagcttagctcccacttatcagtgagaacatatggtgttggtttttccattcctgcagaactctttcttgaagaaaacttccatcttttctctgtgccattgaggtgtaaatcttctactctgtcttctcttggaccaaaaagccatctctttgaaacttccagggagttacaaacttccaggaaaattactttctacccccaaacccaagggaaacaaaagtggggttaggggaggctattaagaaaaaaactggcaaataaaaattcctgaagatttcttccacaaatattggtaagaaactttagccatctgagcagatttgtctcatcttccagaagcaacttaaattcagctatttttaaaatataaactaccgagctttgtgttattgtattgtaaaattttaaaacaaaagctacataatctctatttgcatctgtctgtttatatatgtgtgtttgcatgttatgttatgtagtatgatatttttctaccttcggatgatatgaaattaatatataaaatcccttaaaggcattctatttaattagcttgaataaaataagtgcttacataaatttagtattcctttttttttttttttttttgagatggagtctcgctctgtatcccaggctggagtgcagtggcacgatctcaggtcactgcaacctctgcctcctggtcctggttcaagcaattctcctgcctcagccccctgaatagctgggattacaggcacgtgccaccttgcccagctaatttttgtatttttagtagagacagggtttcaccatgttggccaggctgttcttgaactcctgacctcatgatccacctgccttggcctcccaaagtgctcacaggcttgagccaccgtgcccggccaattaagtattcttaagactttcagaggtgtagaaatgagtccaaacgtttctttttttaagttcacgtaatttgtgatactctttggtaaagaaagttttaagattgctgacaaaataaaaacacggtttccagagctgttagcattaaacataataaagacatacacttttttctacctagtttactagtcaaacaaacttatgttatctctattagatgtttaagattacaaagctataaatccaacctaagaacaacattaagaacaaattgcttgatgcatgttaagtgtggcagtgaggaaaacaaataaagaagaaccatatatttgctgttgtaatttccttgcttctgtgatttttttttactacttgcctgatatgtcaacaataaaaaaattaaataatttagaatgatagctacttttgtttaatgtctcatgaaattttcctgagcagtactggtgggaataggcccccaaaatctggccataaactggccccaaaactggccataaacaaaatctttgcagcactgtgacatgttcgtgatggccatgatgcccatgctggaaggttgtgggtttactggaatgagggcaaggaatatctggcccacccagggcggaaaaacgcttaaaggcgttcttaaaccacaaacaataacatgagcgatctgtgccttaaggacatgctcctgctgcagataactagctggagcccatccctttatttcggcccatccctttgtttcccataaggaatacttttagttaatctataatctatagaaacaatgcttatcactggcttgctgtcaataaatacttgggtaaatctctgttcgaggctctcagctctgaaggctgtgagacccctgatttcccactccccacctccatatttctgtgtgtgtgtctttaattcctctagcgctgctgggttagggtctccccagccaagctggtctcagcacagtacaaatataattgttaagaataagtaaattacataaatgtaagtgagattaaaaatgtacaaatgaactattcagcaatgattatgttttataatatgtctgcctgaaaacacttttcagtcttttggtaacttgcaaccttaaggttatgctaaattaaattaagtcatagatattcattaactgtctgggtcattcctaaataagataagctattgaaatgttaattactaagcaggagtaggcacttataaaccttgtttttatgtgatataaagtaaatatattcaaatttattaataaacaagaaattgtaatatgaggaaatagcaaagagctacaaaaatgtgagaggaatccttttttaaaattcaatttaatttttaatttttttatttcaataggttttgagagaacaggtggttgttggttacgtggataaattctttggtggtgatttctgatattttaatgcacctgagcagtgtacactgcacccaatgtgtagtcctttaaaccttaccttcctcccatccttccccacaagtcctcaaagtttgttgtgtcattcttatgcctttgcatcctcatagcttagctcccacttataagtgagaacatacaatgtttggtttgccattcctgagttacttcacttaggataataatctccaactccatccaggttgctgtaaatgccattatttcattcctttttatgcctgagtagtattccatcgtgtgtgtacgtatgtgtgtgtgtgtatatatatatatatatatatatatatatatataaaaatatatatatatatatatatatatatatatatatatatatatatatatataaatacaaattttatttatccacttgtttattgatggacatttgggctggttccatatttttgcagttgcaaattatgctgctatagacatgtgtgtgcaagtgtcttgttcatataatgacttctttttctttgggtatatacccaggagtggaattgctggatcaaatggtagatgtacttttagttctttaaggaattttcacaccgttttccatagtggttgtactagtttacattcccgctaacagtgtaaaagtgttcccttttcaccacatccatgctgacatctattattttttgattttttgattatggccattcttgcaagagtaaggtgataccgcatagtggttttcatttgcatttccccgataattagtgatgatgagcattttctcatgtttgttggccatttgtatatattcttttgagaattatctattcatgtccttagtccactttttgatggtattgtttgtttttttcttgctgacttgtttgagttccttgacgattctggatatcagtcctttgtcagatgcatagtttgtgaagattttctcccagcctgtgggttgtctgtttacactgctgattatttcttttgctgtgcagaagctttttagtttaaataaggcccatctatttatctttgtttttgttccattggcttttgggttcttggtcatgaagtgtttgtctaagccaatgtctggaagggtttttctgatgttatcttctagaattgttacagtttccagtgtcagatttaagtctttgatccatcttaaattgattttggtatagggtgagagatgaggatccagttttattcttccacatgtggcttgccaattatcccagcactatttgttgaatagggtgtcctttccccactttatgtttttgtttgctttgtcaaagatcagttggctataagtatttggctttatttctgggttattgattctgttccactggtctatgcgcctatttttataccaataccatgatgttttggtgtctatagcattacaatagtttgaagtcaggaaatgtgaagcctccagatttgttctttttgcttagtctcgttttggtggtgtgggctcgtttttggttccaatgaattttaggattgtgttttctagttctgtgaaggatggtgatggtattgtggtgggaattgtatagaagctgtagattgcttttggcagtatggtaattttcacaatattgattctacccacccatgaacatgggatgtgtttccatttgtttgtgtcatctatgatttcttccagcagtattttttagttttccttatagaggtcttccacctccttggtaggtatatccctatgtattttattttattttttgcagctattgtaaaaggggttgagttcgtgatttgattctcaccttggtcactgttggtatatagcagtgctactgatttgtgtgcatagattttgtatcctgaagctttactgaattcatttatcagatctaggagctttttggatgagtctttaaggttttctaggtataagaacatatcatcggcaaatagcaacagtttgacttcctctttatcgatttggaggccctttatttctttctctcctctgattgctctggctaggactagtactatattgagtagacgtggtgaaagtgggcatccttgctttgttctagttctcagggggaatgttttcaatttttccccattcagtacaatgttgactgttgtcatagatggcttttattactttgctaagggtattaatcataaagcggtgctggattttgtcaaatgatttttctgtatctattgagataaacatgtgatttttgtttctaattctgtttatgtagtgtatcacatttattgacttgcatatattaaaccattcctgcatccctggtatgaaacccacttgatcctggtggattatctttttgatatgctgttggattcggttagctagcattttttttaaggatttttgcatctaggttcatcagagatattggtctatagtgtcctcttttgttctgtcctttcctggttttggtaatagggtgatactggcttcatagggtgatttaggaggattccctctttctctatcttttggaatagtgtcaataggattggtaccaattcttctttcgatgtctgatagaattcaactgtgaatccatctggtcctagatttttttattggcatttttttcagttgtcatttcaatctttctgctttttattggtctgttcagggtttgtttcttcctggtttaatctaggagggttgtatatttccaggaatttatacatcttctctgggttttctagtttttgtgtgtaaaggtgttcatagtcgccttgaatgatctttgtatttctgtggtatgggttgtaatatctcccatttcatttctaattaagcttatttggaccttctctctctcttcttttcttggttaatcttgctaatgaaccctcaattttgcttatcttttcaaagaaccagctttttgtttcatttatcttttttatttcaatttcatttagttgtgatctgatttttgttatttcttttgttctgctggttttgggtttggtttgtttttgtttctctagttccttgaggtatgaccttagatcatctatttgtgctgtttcagactttttgatgtaagcgtttaatgctctgaactttcctcttagcaccacttttgctgtatcccagaagttttgataggttgtgtcactattattgttcagttcaaagcatattttaatttacaacttgatttcattgttgacccagtgatcattcaggagcagattatttaatttccatgtatttgcatggtttcgaggattccttttggagttgatttccaattttattccactttggtgtgaaagagtacttgatataattttgattttcttaaatttattgagacttgttttgtggcctgtcatataaatggtctatcttggagaatgttccatgtgctgatgaataaaatgtatattctgcagttgttgagtagaatattctactgtaaaagagtccatttattctaggttatagtttcagtccattgtttcactttctgtcttgatgaccagtctagtgctgtcagtggagtattgaagtcccccactattattgtttgctgtgtgtctcatttcttaggtctagtagtaattgttttataaattttggtggtccagtgttatgtgcatatatatttaggattgtgacattttccttttagactagtccttttatcattatataatatccttctttgtcttttttaactgttgtggctttgaagtctcttttgtctgttataatagctactcctactcccttttggtgtccatttgcatggaatatattttcatacccctttaccttaagtttatgtcagttcttatgtgtttggtgagtctcttgaagatagcagatacttggttggtgaattcttatccattctgccattctgtatcttttaagtggaacatttaggccatttacattcaatgttactattgagatgtgaggtactattctattcatcatgctagttgtggcctaaatatcttttttttttctcattgtattattgttttataggccctgtgagatttatgttctgaggaggttctattttggtatattttgaggttttgcttcaagattagaactccttttagcagttcttgtagtgctggcatgatagtggcaaattctctcagcatttgtttgtctgaaaaagactatctttccttcatttatgaagcttagttttgctgaatacaaaattcttggctgataattgttttgtttagggatgctaaaaatatgaccctaatcccttctagtttgtaaggtttctgctgagaaatctgctgctaatctgataggttttactttgtaggttacctgatgcttttgtgtcacagttcttaagattttttcttgcatcttgacattagttaacctgataactatgtgcctaggtgaatgatctttttgtgatgaatttcccaggtgttctttgagcttcttgtatttggatatctagatctctagcaaggccagggaagttttcctcgattattccctcaaataagtttaccagacttacttagctcttttcttttcttttcttttcttttcttttctttctctctctctctctcttccttctctttctttctttcctttctttcttctctttctctgtttctcccttccttccttcctttctctctctctttctttccttcctcacttccttcttctctctttcgctctctctttctttctttctctttctctctcttttctttctctctctgtctctctctctctctccctgtctctctctctctctttctttctttcacatctcactcagtggcccaggctggagtgcagaggcatgatctcagctcactaccacctccacctcccaggttcaaataattctcatggctcagcctcctgagtggctgggattacaggggcctgccaccatgcctggctaatttttatatttttagtagagacagtgttttgccacgttggccaggctggtttcaacctcttgacctcatgtgatctgcctacctcagcctcccatacttaaattttccttcttccttgggaacaccaattattcttaggtttgatcatttaacataatcccaaaaacttcttgaaggcttttttcattttttaaaattcctttttcattgtctttgtcagattgggttaattagaaagccttgtcttaaatctctgatgttctttcttctacttgttcaatgctattgttaaaactttctagtatattttgcattgctctaagtatgtctttcattatcggaagttgtgattttttttaaatttatgctatctatttctctgaagacttttttcatccatatactttattatttttaaatttctttaagttgattttcacttttctctagtgcctccttaagtagcttaataatcaacctcctgaactctttttctggcaattcagagatttcttcttggtttggatccattattggtgagctagtatgatcttttgggggtgttaaagaaccttgttttgtaatattaccagagttgtttttctggttccttctcatttgggtagagtatgtcagaggcaaaatctggggctcaagcgctgctgttcagatgttttgtcccacagggtgctcccttgatgtagtgcttctccccttccctagggatggggcttcctgagagctggactgcagtgattattattgctcttctggaggtagccacctagagaagctaccaggctccaggctggtactggggagtatttgcaaagagtcctgtggtgtgattcatcttcagctctctcagctgtagataccagcacctgctccagtggaggtagcaggggagtgaagtggactctgtaagggtccttggttgtagttttgtttagtgtgctgggtttctcgaatgctggttgtgctagcagtgaagttgtcatatggacagactcaggacctctggttttccaggatgttgcaggtggtggaattagcttccttttggttgttttctcctttcttggagcaggaaaaaataattttattctgaaggagaatgactggttgttctagaataggaaagcagataaaaaccggacaaaaactgagaggatataaaaaataaaaaatgttgtagaaaattttcaaaaaaggagtttgtgtggttgagctgctaagattgagtggatttatctatgagttaaaaaatgataagtcttagggtcaaaagggtactaatataaaattaaaatggcaatgttttttcagattgttagtctgctcttaataaattgtgaaaggtttttttttgtctctgagtaatctccctagaaaacaaatatttttgtgttttattaaaaataattttctgtgcttcttgtctttatcaggtctttaattacctaaggaagctgactcttctcaatattaaaaaaagctagcttttgttctcacctatgtaaccttgtatatttgcctttacagtattttattatcactttatttaaacagatagctaagtattatataataataatctgagattatatcctaggatctgtgatcctaattaagtattaaaaccttttgattttttttacatctcaaaatcaaattctaaatgtggcctttttttttttttttttcttaccttgaactaactttgatcttttcttgggggctcctggaaaaacttaaaattttttttgctcttacaaaaagatatatgttaaactacttaggcttacttggtagttaagttacatggaaaacattgccaaataagatgtgatgttgaattttctttaagttatatttgtatagatatgtagtattaatataagtgtttcagaaattctgtgaggtcaacaaaaatttgtcaataccctagctgtttatgacagtcaaccataatgttatcaggtgactgataaggacctctctgatggctcatagaacctccttctgcaataaacatacacctggagtgagctgataaagagaagatgaggcttcctcaggttttgaattttataatgatctaaatggagaacctttgttaaaaatctgtgactttaatttaataaaaataaagtgtccaaacagtctcttaaaatcttttgtgtaatgattgcttgtgggactctggaagtattgttttaaattgcctatgttgtgaatatattgttatcctggattctttctcccacatccctaagctgacatcttcatagtcaagcttgaacttgaccatgaagaagcaaggaaaaatgaatattctctccagcccctttctagattgtctaatggtcattggtttctaaatgactttgaataccactgctggtaggaaaactcttacatttaaacaggtttctccactgcagaacttgttagtagaacttttcatctgcgcaattgaaatagaaattgggacctaccactgatgactaattaacagctgtatccaaataggttggtgtgaacttggaggaaggtcattaagacatttgtgtgaaaaaaaatctgaatgtctgaggctagcttaatgcaaaaactggtaaaagcaaatgcactcatagattcccagagctctactgttagtgtgcaaaatgtaaactgttactttttaagtgtgtacaattgtgaaggtgagagattcagagctagatcatatctccgggtatgaagcttgcagatgaccaagacagaatgtgatccttcttcaacctgagggagatattgagtagaggggaggcaggttggatgtatttttccagattcaaaacagaaaagattctggtatccagcatattttggttcagggtagaactttaataacaggaaggaatgttcttttcttgacatccacttctttcttcttccctttgttgcggagactttggtaaacaatccaaagaggtaaactgtatcagcccagtgatatatcaatgaacaccttccagaggtcaataatattatcaagataaaaaatgtttgtcttgaatttttgattttctttgaagaatctgaagaaataaaatatcttccagagattctgtcaaaaatctgggagtgagtctctgaaccctaggggtctcacactgttatcgacaataggttggatctgagatcctggcaggacgataaggtcctagggagaagaagagggatatgagaaatagggagcataaactttaaataataaagttcagaaaatatgattaaacattgagattatccaagcagaaagcttgaggatggccacttgggaacaccaattccaaaccaatggaatcagcattccaaagtggagaagttacggtttcacatatggattagtccattttcacactgctgatagagacatacctgagaccgcacaatttacaaaagaaagaggtttaattggacttacagttacatgtagctggggaagcctcacaaaatcacggctgaaggcaaggaggagcaagtcacatcatatgtaaatggcagcaggcaaagagagagattgtgcagggtaattcccatttttaaaaccatcagatctcgtgagacccattcactatcacgagaacagaatgggaaagacctgcccccatcatctcccacccggtccctcccacaacatgtgggaattatgcctacttatgtaggcagagacagagaaattttacactttccatacaagaccagtgcatagttacaaagatttgattggttacaaattgctacattccaaggaagattattactcggtgaggagggatagtgatctgagggagtcttatctctggtgctgtctggtcttcctaattatttacaggaagaaaatgcagcagactgtatagacatacccccttaagggtcagaataatttaacgttacgacagctttaagtacaattatttaatttcacattttccccttttcattaagatctttcaaagaaagtcttgtagataaactcaaatggtttgggctccttttggttcaggagtttaatcccacatcactaggaaggctaattcttagagtgtcatgtctcacagaagaaggagtttgtcaggctctaaagctgatggggtataggctgaatttaaagcaacataaaggaagtggctttgagacctgagtcaggctgcatggctacaacttcaattaatgcaattctttgaatgacaattattttagtttttttcagttgtgcattgactacattgtgaaagaatgcctcagcagcagtaaagacaaaacaaaacaaaggattatagttttgagaacaagtaaccaccaaattctgcaagatccaaaccagctgctcagccaatcttttagagaggatattggatctgaaagggtagttttttaagctttcatattggtgattaagttagtgatgatctgactcatctggggtacagacataacactcagtttttatgacagcacaggtttctccttgggctgcagtgagtatgtctgcagcccttctcataagagcaatgccattgtttaataacgagataaccatgcagctatcatttagggcctcattttatatagttggttagggcctctacatgccaaatggcatactcaatacacagttgggcagaaagatggaagctaaatgatcatactgatgggatacagaacaaacccattgatattataaatgaggaagatttgcaggccttgaaggaatatgaactgctcaaccttgtgcccaggcataacccaaagaacaccgtcctaaccatcctaggggtaaatgtgaccacagattggtgccacacagccaagatacagccatttagagctagccagtaaatacccactctctgtgcccattcaggggcatgtcaatcagtactgtgtgatatactgatgtggttagacatttccttggttatccatcacatatctctagtgctattgagccatgtatctttggtgtgattctttcattcccaacttaaatctgaccaaaagaggaggtaagccagctaaaacagttccgaatttgtattatatcatccccaaattcagttgctttatctctcagttgggtcagtgccagcattaaagctaataaattggtctcttttactgaaatgctcttcccatgtgctttgctttgtatagtattattaacaggccagtgacgcacgtcatcctttgtcatgctagtatgaagcagtgatcactgttcttgagaaacatggatatatttctgacattctatctaatcttgtctttggaaaggagatatccaccatggcaggcagaaccactggagaagggcatgaggccacatacccaacaagtgtttttctgtaatctgctagcatggtcctgagcccactgaaagaagaggtttgctatgggcaataactgttgatagtggcaagaaagcccaagaactagggacataaaaacaaaaaaagaaatttagtgggaacttcaaagaaagatattctccatctactaacaattattaatgtttagcatttatatagatacaggattagtccagtgtcttaggaaagctgtttatctcagatgttgtctttttctcattcttgttggttctggagaatttttttagatcaccagtttgagacaaagttcaaattggtgaagtggctttctttttttcttcttcttcttcttttttttttttttgagatggagtttcgctcttgttgcccaggctggggtgcaatggtgcgatcttgcctcaccgcaacctctgcctcccggattcaagcaattctcctgcctcagtctcctgaatagctgggattacaggcatgtgctaccacgcccagctaatttttttgtattttttagtagagacggggtttctccatgataatcaggctggtctcgaattcctgacctcaggtgatccacccacctcagcctcccaaaatactgggattacaggcgtgagccaccgtgcccggtcaaagtggctttctttaaatgggtgacatgagtcaattccttttagcttagtggcatgaggattggttgggagcacctgataattccctttcatcttggctggaggaagtcttttaaaagatcttatttccaacagacaaaatctcctggttgaagtccatggtcctagaatttttcatcctacaggaggtcactgtggaaagagtcttttactaaattatagtttctagttggctgccttataaagctgttgcaattattcaacatattcttttaataccatagattcacagttttctggaaataatttcataggtctgcctgttataatttcaaatggagacagttggtatttaccaaaaggggttgagtttaggcaaagtaaaaccaatggaaaaggtttcagacaaggaattctacaaagctcagcaaatttttgccaattgagttttgattattctatttgtgttgagagttaaactctgaccttttttcttctgttgtccaaattcctacctaaaaggtttggggagtcatgcactacacaccataaagtctcctcagaagggcttatttaacatagcctgctttccatcctgactctggcataacattacatgacagataatgaaagaaatcaaaatattttaactccaaatgtatttccttgccatattttgaaattatcctgcaaagtcatctcttgaaaaacctatgttctgtagagaatccccttttcctttccaggcatttttcctgatccaggagagaatcagctaagagtctggcacctttttaagtctgataagaatcatttacaatctattgtctttgaaacccactacctgggggattcatttgcataataagaaccttggtcggctggccacagtggctcactttgggaggctgaggtgggtggatcacctgatgtcaggagttcaagaccagtctgaccaatatggtgaaaccccatctctactaaaaatacaaaaattagatgggcgtggtggcacacgcctgtgatcccagctacttgggaggctgagacaggagaatcacttaaacctgggaggctgaggttgcagtgagccgagattgaaccactgcactccagcatgggtgacagagtaagactccatctgaaaaaaaaaaaaaaaggaaacttggtctccacaaccccttatcttaacccagacatttcctttcgattggtcctaggtttttcaataaagtcttttaaccaattgctaatcagaaaatatttaaatctaccaataacctggaagccccgcacacccaccttgagtggtcccgcctttttggaccaaagaaatgtacatcttaaatgtatttgattgaagtctcatgtctcctaaaaatgtataaaaactaagctgcaccccaactgttaatggtggagggtctccaggtacttgacatcttgaacaaagaattggacaaaatgcacaaacaaatcaagaaaggaatgaagggttttattgaaaatgaaagtacagtccacagtgtgggagcaggcctgagcataggggctcaaaggccctgttacaaaattttggggagtttcaatatcctttgctttgggtatgccctatgtaaatgaagaggatgaagtaaagttacaaagtcatttacttggactacactctatggagaggctatttcctgtcacagctgaagtgtgaatcggccttatgttcactgcctccagaccctattttcctgcctcatctccccaccgagagatgtgatgaacccaaagcccaaggtcctgaagttttgttgtagtgtggatggcaaggaaactctccaatgttctcagaagatccaaaccataaaaagcctttttacctggtgaaaatacactgcagcataataatctactgttataacatcagccatcttgcatgagaaagctttacaaccagaaaacatgcattgaaaataacaatcaaatgaaatccctttataacgtttaaatggcctaccaggtattttcttttcttttttctttttttttttagacagagtcttgctctgtcgcccaggctggagtgcagtggcaccatctcggctcactgcaaactgcacctctgggttcaagcaattctcctgtctcagcctcccaagtagctgggattacaggcatctaccaccatgcctggctaatttttgtatttttagtagagagggggtttcaccatgttagccaggctggtcttgaactcttgacctcaagtgatctgcccgccttggcctcccaaagagctggaatcacagacatgggtcaccatgcctgacaaaatgtacgtgaagctttaattgttttcccaggaatatggggtcaagcattggttataaactattttaaacaatttcagtgtcagctggcttaacatgaaaatctgacaaagtattttcttggtatttaattaatttttgggttagtagctttatacaaggaaatttggttatttctgtggtttacaataacataataaccataattataattgatagcatatactattttagaaatcccatataagtttggaacatatgttagattattcacaaaaatataacctaaagaagattgaacaccattttggcaatcccatgtacctaaacatgtcaaataatcctgtttacctcttctctgtatgttttcagggccctctgatccatccagaaagccaggcattaggagagacaattttgaaactgaagttttattttggaactccatattaccataaatcatttattttgccaaaatgatgactcagaaattataaagaagcaaaaaccttttataaccttttacaaaaagggcacattctcctgtttttacatgccttgtatgtgaaactgtttgtagtagtcttaaatgcatgttacagtggtaactcttagcaattttcactttagtgtaaaacctagtaagttatgttctgataaggtttgactatttccagcatagctggggcatggccaaccccacatgttcctaggcctcacctagctggaaagcaggtgagttaaacaattttcaaaagcaaaaaaagcagcctatgaccttaaagcatatagcaaacctaacatttcaacataatttagaccacatgtttacattttgaagacaattgtattttaccaataatctttaaaaccctcttttttttttttttttttaagacagagtctcgctttgtagcccaggttggagtgcagtggcatgatctcagctcactgcaagctctgcctcctgggttcacaccattctcctgcctcagcctcatgcgtagctgggactacaggcgcccaccaccacgcccagctaattttttgtatttttactagagacggggtttcaccatgttagccaggatggtctcgatctcctgacctcgtgatccacccgccttggcctcccaaagtgctgggattacaggcgtgagccactgcactcagccctaaaaccatctttatttcccaaagattgctaaagtcatgtaagctaaaaggcattacattttctacatttctgacaaaatatttgatttaagctcttattgttattaaaccaattaatttaaaagtttacagaggggataaacagtgactttttctttatatttaatcagtttacacagacagaaagaggccagaaactgactggtgagaaattctcacccttttgctggcatgccaggtttctgggttctctctccctaagcagccctggcagccctggcagccctgcttgactgtatgcaaaaaaacacattgtcatgaattaagaatattcacaaatagtttacaaatgttggagaaattaggcagagggagaaatatgactcaaattctatttatgaaagtatactcagcccatttaaagtatcaagaagcctaaaatccaaaaagttagtttatagctggtgtgctccatcaattcctgcagcttgacaaaagtagcttataaattccaggtaaatgaagtgaatgatgacttgctggaaatgccaaggaaacaaaataactattcatagaaccaaataaaagccttctactagaaactaaaaagcatcagggttttatatatatggatacacaagcaaagccagaggagaataaccagcaaatgaatgaaaactagaagcaaaaacaaataaacagaaaaccaatcctaaattttcctacttaatttaccctggaggctacagtgttacctagggccccccaaaacccacataatgaatattttattcctgatacacaattcaatacccttaaattcaccaatatcattatacttccgtgcaatcaagaagatggattacttgaggtcaagagtttgagaccagcttggccaacatggtgaaacctagtaccactaacaatacaaaaattagctgggcatggtgatatgtgcctgtagtctcagctacttgggaggctgaggcaggagaatcgcttgaacccgggaggtggaggttgcagttagccgagatcgagccactgcactccagcccgggcaacagaaaaagactcaatctcaaaaaaaaaaaaaaagaaaaagaaaaagaaagaaatcctctttaggcacatgaccaataagtactctaacactagccacacaaaacagtaaccatagtgtgaaacaatgcaagcgtgtatgtgaaatttggctttacactaaatccagcttcatgtttaactatattaaaaaaagaattgccaaactgccgatgcattgtacaatactttttattttattttaatcaagattaagagatttaattacgaaaatgctaattagccaaatgtttccaattctttatcaggttttaaagaatattttattatttaaactttttccacatctttctccctgtttaaaaattccttactacattgtttcataaataaccttttgaaagctctgtaatttgagctaacttttagataacttctgaataggcaaaataattttttttccactaataaccctttctggcacgttttgtatacagaattacgtgttaactagaattgtatccctagtaacctaaaactttagcaaaactctaaaaagcaagaaatcctgaactattagatatgggcattcataaataagaacaattccacaattttagaaacatatttccctatattacaaccctttcttaattggaaatgacccagatattaaatgaatgttaaaaataagattttaatttacaaaaaaagtttacctaaaacatttatcccattcactgtacttaatttttttttacttttaacaagggagacatgagatatcaatcaacatatgtaaaatgaacattggttccatctggaaaggcaggacaactagaagctgggagggggttagggcttccaggttacaggtaggtgtgagaggaatggttgcattcttttgagtttctgatgagcctttccaaaggaaggaaccagatatgcatttatttcagtgagactttgaatagcttgctccaagcagctaccagcttgaattaacactgacattttaaaatatctagcaaagacaaacataaaattcagacaaaatgtatgttgacaattctgaaggcatttctatttttatcccaccaataattttaaagctagcttgtttagtaaaggtatactttaagtcacatgaacttgaaattcttagacttatttacttaatttatgagtgctcttttacttataagccaatttgatagacacaacatatgtacaacagtgtacatacaaataaacacatctagacatgtatacacatacataaatgaagatccaatagcttggaaccttagccatgagatagcaatacaagcttgctggttttactttgccccaatagataatccaatgaaggctgtgaaccaaaatttcagataaagcagtctccatggcagtttgatttttttttttttttgagaccacatcttactctgtcacccaggctggagtgcagtggcatgatctcggctcactgcaacctccgcctcccaggttcaagcctttctcatgcctcagcctcctgagtagctaggactacagttgcccgtcactatgcctggctagttttttgtatttttagtagagacgaggtttcgtcatgttggccaggctggtctcaaactcctgacctcaggtgatccacccaccttggcctcctaaagtacttggatcacaggcatgagcagtgatcccagtggcctggcagttttatttttaaaggccaaacctccccagattcccaagagcactggggccaaaccaagccaaaggagggcgtcacacgtgaaccaggccccctgcttagaacggcagcacaaaagtctggatacatacaatgctattccactttccattcaacagtaaactccagattccaaacaatgttggagccaaacagcattgccactgtgagagaaaattctaaggagggttaatactagacctcagaacctctgacgagagcagcccttttgggcaggctgaggtctgctggacccccgggagcgtcttcctgtggggcccgatcttagagtgccagacatctctggccttaggtgggtgccacatgcaggttttccccgccagagcctattatgagctttataagaacagacatgaactgtaatgtgaagaactggatgccgggtgggcctttttgttcctcagccagttgagtatgatcagggaaaaatttagcataggaaaagaaggtttacgtcccctgaaacatgtgcgagtttgctccaagctgtgcttcatgtagggatcagggaccatgcgtggaaaatatttttaaaaagtccttcccccttcggggcagggcaattgtaaatggcagctgaaagaccgaaaaagaaagaagggaaaaaaaaaagaaagaaaaagacccaagttccttaagccaaccaggaggtggcagtcaggcttctccacatggaaactccttagtttcactggccacggccagaaacctgcagttccttccatgtttgggcgctgcccaccaagggtcccaagttgaaaaggaaaagagagggagagagagggcccctgcatggagcagaaaggaaagggagaaaaatgaatcccaaactttgggcttacatcttcctcctggctggctgagcaaaatctgctaatggtggaaggtgtccaggctcttgatgtcctcaacaaagaattggacaaaatgcacaaacaaagcaaggaaggaatgaagggttttattgaaaatgaaagtacactccacagtgtgggagtgggcctgagcatagaggttcagaatttttgggagtttcaatattctctacttggggtatgccctatgtaaatgaagaggatgaagtaaagttacaaagtcatttacttggcctatgccctacggagaggattgtgggagattggttatagtggtgggaaaaatgatagggaaagggcgcaaaccttctgaaaggtcggagattctgcagagcccatgggagaatagctgaaggcagctgttgtataaccctgatgcagggggcaaggagtaggtacaagggaatgcaggcgaatttatcataaacaggcttgtttacttatgttgaccaggaactgacctttgatcatctgcatgcctgacattctctgaaaggggaacaataaatgttaactacctacagcttgtgtttgctccaggcttttggcattatgcctgcactgaataaaagcaagcagctccagcttctctgggctgctctctggccactagagccaggcagtcacctagctgctcttacactgcatgcctgtgtgtgagcactcatttcatctgtcagccagggtctgcaggacagacctggcaggaggtgccctgtgtgaggaacactgcaacggatcacgacagaaccctcaaaaatgaaagtgaagtgactgtgcagtaaataattggtgcctgctggggattgatttccaagtttgaagggattttcaagctggggtttcatcatgggacaacagttatcagcttaacagcaacagtatatgaaagtgttgaaaccgctgattaaagctagcaaagccttgctctcagagtcccagttaagggacctaatgcaaactgttgttttccataatccatcattctcagaaggcacactagacttaaagctctgggaacaagtaggaaaaattcttaaataacattatgtacaacgacagtgagtcccagtaacatctttaacgttatgggccttagttagggctgctttggccctgctttacacagaagagcataaaaagggaggggaggaagagccatcatctactttaccacctcatcctcctccctcagccctgctgttaccaggtaaaggtgccacagaggggacagattttccctgagccccctccctcagttaattggaaaaaagacaagggatacactatagttatgggaccctgtcttaagcaagtggcattagaaggggagctcttggcttgcctggtgatgcaagatcaacaaggcaatggggtacatgaacccattactttcaacacttataaaaaataagaaaaagcattagagaaaatggagccacttgcccatttacaaggggattaattgaggccatagcagacaactaccatatgacccctttctgataatagccactgttgtaatttctcccctacccctgacatggctccaatttgggacatgacaagatccagtttgggtagaaaagtggccttaaaagggagacaagttaacaatgatcccacgaattagttgagggacaattaacagctggccatatagaaccatcaaacagcccttggaattcatccatttgtgtcattcccaaaaattctggtaaacggagacttttgtatgacttacatgctatcaatgctaatttgcaacctatggggccccttcaacagggggtcccttcccctgcagtgattctttgagattggcctggagtcattattgacttaaaagactgcttttatgctattccccttgcagaacaggacagagaaaaatttgcatttgcaataccagctatcaataatgaaaggccagctcactgatttattgaaaagtacttcctcaaggaatgttgaacagtcctaccatgtgtcagtatcatgtaaatcagactttgctccccagtagaaaagaacttcctaatttcaagatcatccattatatggatgacattttactggcagccctaacggagccaatacttttgagtttatatgcctctgtcaaaaggaatacacagttaagagctttaatcatagcacatgaaaaggcacagatgtcctccccttggaaatatcttggatatatactaactttctggtcagtaagacctcaaaaggttaaattgaatactaacaatttacataccttaaatggctatcaaaaattatcaggtgatattaactggcttcaccccaacttgggcataactaccgacaaattacagaacctgttttctatcttaaagggcaatgcagccctggactcccccaggtatttaacccctgcttcaaaaacagaaattgaggaaatagagcaagctatttctcagaggcaactagattgcatagacccacaatattcagtccaattatttgtatttcctattaaacaacaggattaataggacaccttcagatagtactctctaattatgcaggccatatagaacatccccttcactgatgaactattccaattcttatctcatactactgtagttatgcctacaaaggtagttcactcccccatacctaacactttaatgctttccactgatggctctggtaaaaatggaaaagcagctatctggtgggaaccacataactcccttactcgatctggatttactagtactcagagagctgaggttggagccctaatattggctctggaaaccttttccactcagcccatcaatgttgttagtgactctgcttactctgtttatttattctaaaaccttgaaacagccctcattaagtccactcttgagcccaccctgtgcatcctttttctttgacttcagcaatcgctgggtcagtggacacattctgtttttatcacacacattcggacccacagcttgctgcccggtccactagttcacggcaatgatcaagcagacctgcaggttatgacatcactgcttggccaagccacccaatcacatcaatttttccaccaaaattggagaaatttttctaaacaatttcagttaacctaaagactagctaaacaaattatcctgcagtgcccagattgccagctcacaggcaagtccccttcctcaacaggtatcaaccctaggggactagaaccaaatcagtcatggcaaacagatgttacgcatgtccctgaatttggaaaactaagatatgtacatgtatccatggataccaattcccacctaattgctcttcctggagagtctggctgatatgtcattaaacatcttcttctcttttgtgtttatggggttgcccacagagattaaaactgataacagtccagcttacaccagctcacaatttcaacaattttgtcacacatggaatgtccaacattccacaggtatcccatataatccccaaggacaggccatagcagaacctgcccactctacccttaaaaatatgctcagaaaacaacaaagggggaatatgagtaaggaccctgaaacactattggcacaagccttatttacccttaatttcttaaatttagaggataagtttcaatcagctatagaaaagcactttgcaaaaatcactcaagatataaaaccttcattttatggaaagatgtaaatagtaatgtatagtgtggtccaaatgatttgctaacgtggggaagaggatatgcttgtgtgcagaccccctcaggtcctctttggattccagtatgatgcatcaaaccatactgtggtgtggctagaacccaacctggtaccagaaatgaaggaaatgaccttgcaggacccacagccctggatgatgcagcttcctcgggcaacacagaccctggacattttgctggagaagataactcaggaggcttagcaaatcctgctccagacacagataccattcactccagataatttgttccttgctatgctttctgttgtacattgcatctctcatagggtattaatcttttttagtctcttactttgcctgctacctctacctgctacactctattgggcccatcttctagatctgccttttttccgccctgttacttgggcagacactcccttcccagcctctaacaacatgaatgattggctgggagggactgacataccaccgatggggtccctcagtaatggcacacattggactgaggtgccaagtaacactacatatcgctctttgattggaaaggaataatactgattatactcatgtttgtcttatgttatttactggttctaggatgcaaagccggaacatgagctgtaactgccgcaccagtcaaacctgtcactgtgcacatcaacaaaacctgatgcagacaaaacgaaacaaatcaaaacaaaacaaaccagaaaagggggagatgtgggggaccagtcagagtggtgggaaaaactctagggaaaggacacaagccttctgaaaggtcggagtttctgcagagccccatggggagaatagttgaaggcagctgttctataaccctgatgcagagggcaaagagtaggtacaagggagtgtaggggaatttatcttaaacaggcttgtttacttatgttgaccaggaactgacctttgatcattcccctgaaaggggaacaataaatgttaattacttacgggttgcatttgctccaggcttttggcattatgcctacactgaataaacgcaagcagctccagcttctcagggctgctctctggccactagagccaggcagtcacctagctgctcttacactgcatacctatgtgtgagtgctcatttcatccagggtctgcgggacagacccagcagaggatatttcctgtcatagctgaagtgtgaataggccttatgttctcttcttctagaccctattttcctgcctcacaaccaccctgggcacatgttctcaggatctcctgagggctgtgtcacaggccatggtcattcatatttagctcataaggagctggacaactcgaatcaggtggtggggtctgggcaacttccaggctataggtaaatttaaacatttttttttttgagacagagtctcactctgttgctgggctggagtgcagtggcgctatcttggctcactgcaacctccaactcctgagttcaaacgattctcctgcctcagcctcccaagtagctaggactacaggggtgtgccaccatgcccagctaatttttgtatttttagtagacatggggtttcaccatgttgaccaggatggtcttgatctcttgacctcttgatccacctgcctcggcttcccaaaatgctgggattacagatgtgagccaccacacctggccataaactctgctttttttttttttttttatcttgcccaaattcctatctaagtggtcaggggagtcatgccctacaaaccataaattctcatcagattggttttatttaatcctatgtattgtgacttactttccaacctactctggcataacattatgagacaaggaacaaaatcaaaatattttatcccaaaaacatgtttctttgtcacattttgaaatggccctgcaagctgtcatttgtggggaaaatttgcctctggaaagaatatctattaagataaacagaccttttccttccaggcccttccaattctgaatcagttaactaagagtctcacaccttttaaaaggtcttaataggaagcatttgtcatctattgtttctaagggcagctgctatgagacttcaaaagagtcttggtctccacagtcttttatcttaacctgaacatttcctttctattgatcccaggtctttagacaaactcaaccaattgtcaatcagaaaatgtttaaatttacctatagcctggaagctgcccagaccccaccaccggattcgagttgtccagcctttctagaacaaaccaataagccaatgtatttcttaaatgtatttgattgaagtcttatgtctccctaaaatatataaaatcaagctgcacccccgcaaccaccttgggcatatgttctcaggacctcatgagggctgtgtcatgggccatgttcactcatatttggctcagaataaatctctttgaagattttacagtttgactcttttcgtcaacactcaggataaatctcttcaaatattttacagagtttgactcttttcatcatcagtgtgttccactaatccagatgactggggatgactggcacaaggaaaatgttgtagaacgggccatatttcacatgctgactggattgtttgtccaataaaatgagtgtcccatacactcataaaataagttcatttgagagaaagtcccaaagttgaaattatttttttctaagggaattttacttatggccaaaggtgatggtggtaggcgaataaactctagttgccatacctcctttcatgcgtgtccatgtgaagagaccaccaaacaggctttgtgtgagcaacatggctgtttatttcacctgggtgcaggcgggctgagtccgaaaagagagtcagcaaagggagataagggtggggcagttttataggatttgtgtaggtaaaggaaaattacagtcaaagggggtttgttctctggtgggcaggagtgggggtggcaaggtgctcagtgagggtgctttttgagccaggatgagccaggaaaaggactttcacaagataatgtcatcacttaaggcaaggactggccatttacacttcttttgtggtggaatgtcatcagttaaggtgggacagggcatattcacttcttttgtgattcttcagttacttcaggccatctgggcatatacgtgcaagtcacaggggatgcgatggcttggcttgggctcagaggcctgacacctccaatcagcctttaaggaaaacaaccttgataactgtgtaaaggtttccacggattatgttttgggcagggatttttactcacacaaagggtgggttcaattgcttggtgggtgacagttcacttgaagtggcattgatgtctggggtaaataccagaggttcgttgtctcacaggagggaaatcaaggacgtgaacatacaaaaagtgagtttaagagtggaggtttaatagacaaaagaaaaagaaaagagaattgctctctttcttgcagaaagagaggagctcctgagtgggttttctggaccactgcatagtgcatggggtcttatagactggcttgagtaggaagtgtctgattaacatggggccaaaagattggttggaccaggtgtgccatttacatagcatgcaaagaagatgaccaccccaccctaatcttttattatgcagctgggttctctacctggccagcgccctgttgtctgctccttactgcacacatggttgacaaagaaaagagaagatgttgggaaaaccagccccacaccacccggtgggtaccctgagtccagcggaggcaaaggagttagaaagagacagaataagagtttaaaaggcaggttcaggagacctgagtgtcagaggcttgctcatggcccagagttctcgggctccacctaatttattggtttacaagctctttgttcttagggcagatgggagggggaggaagggatgaggaaaaggattaatcagtgaaggagaactcttgagtcattcaataagatgtagagcagtggtggtttctgtgaatttcctgagcaaaggcatgtgtctaaactactaagatctttaagttatctggactgaaatgggtgggagtgggtttcaggaggagccaagatgtttgattatactccactgcttcaagggagtgttatctccctgagcaacctgtggaatgccgcggagctgttatgctctcgggcataaagacatgaaggcaataaggagacttttctcctcagaggccgcccatggctccccctgggtgtctcacacaggggagaccaactcatctggcaccctagaaactctctttcccacagaagatggagccaccatgttgaacatgcctagcccccaggtagccttttcctattggcacagctgctgacattcacctgtgcaagctcccagcttgcttatctatgtttgcagctcgattttacaggctgctctttgttaaaaaaagaaatgatttggccgggcttggtggctcaccaaggctgaggtgggtggataacttgaggtcaggggttcgtgaccagcctggccaaactggtgaaaccctgtctctactaaaaatacaaaataattagctgggtgtggtggcatgcgtctgtaatcccagctactctggaggctgaggcatgagaatccctcaaacccgggaggtggaggttgcagcgagtcaagatcatgccactgcactccagcctgagtgacagagaaagaacttgtccaaaaaaaaaaaaaaaaattgggggctactttttattaaaaggaataccttaccaaggattcttaccctcactatctgcctaaataatttctttttaactcctgtgtcacaatgaccacaaccaaggaggatttaacaggggttttgttatttgtaacaagtaaggaggacaccaggcatagttcctaaagcagtgcttccctgagcgatggtggaaacagggcttttactgggctggtgagctgagtcattgtatgtagaggtaaagtcaagtcagtgcaggtgcagttgctaatcatgctactacacacatcgcatgtataggaaaagttgagtaagctcctccctgggtgaggattttagtatggtaatgaggggagttcactgaagttcatttccaaatctagcatctctggatccaactgttttttgtttttcaggtgctgggcttcttcatggaattcaaggtgcaatagttacaagtgggtagtttttcacagtgctaccccaaaactggggacccagggttacaatgcggcagcacttgtacttcttatgagccacagttggaccgagtttcctattatattgtttgccccaagcaatcaaatgattggggcttcaaagagttaaatcttgcatataaattaagaaagattactataatttgattgggagtatgggtagaccatttggtctataccatagcccagtttcagaggagtgtgttcccccttttgtttcccagttttctttttgttttgaaacacccttggcaatgtaaagcattgaagtgctagatgttacttttacaagtcctcagagtgtgcattatgtaactgcttgcctcctcaatcctgtaatccttccccctgtttgtgatggctttcacccttccttccttttcttccttttccttttcttccttccttcattccttttcttccttccttccttcagtcctcccttcctttcttccttccttccctccttccttccctctctccctccatgcattcttctttcctctctctcccttcccctcccctcctcttccctactactcatcctttccttcctttccttttccctttctcctttcctccctcccttcccttttttttaaaaaaaatggatcataatatatttttctgacatttaaacctgtaacttaaaaaattttaataattaaaaagttatatctgtaaaatgtctctaaactttaagcaattgctgaaaacttcaatagcattcagtctagcaaaaattttgcaaaactggaaggatttttctcatttcataatatgaaaagccaaaagaattcactttgtatctaattaatatatttaaattaaaatatactatagagccagaatatgaaatagaatattaagaaaaagtaccagctggttattgagaagtgaaggaaaaggtcactaaacaaattgtgtaaactctaaagtgatacagattaataatggaaagagtaccaccttaatgggtcttaattttctttaaacaaatgagaaaatgaagaaaaaagcgtgttttaaacaaccaccattgaagcaaaaccaattctattgtttcaaaaggtagttatcagctttccatgtcatacgagcagaaatccaccctcaagtcagagatttgatctgtagttaccctcaagacagcaccaccatagtttattcatttcacagtttttcttttctttttctttttatgagacagagtctcactgtgtcattcaggctggagtgtagtggtgtgatctccactcactgcaacttctgcctcctgggttcaagtgattctcccatctgtagctgggattagaggtgggtgacgccacacccagctaatttttgtatttttagtagagacggggttttgccatgatggccaggctggtctcgaactcctggcctgaagtgatctacctgtgtctgcctcccaaagttctgggattacaggcatgagccaccatgcccagccacatttctcagattttctaaagcagatcttttatgactaatgggccagtcctgcctattatctagctgtttgctgaaatcatcaatcctttgatccttagcaatccttaaaagatcagactgtctgagaaccactggagttgacagggatgtcctgcaaaggggctggggataagggagagagagggtcatgtcagagtccagagtttgcatcattgcctgctctttaatagtaagtgagctctgtttccagagcctcagtttacctcaggtttcctgaaatgagaaaaatgttcatgcccgtatcggccttgcagggtcattgtgaagatcaaggaaaatcattgaataaaaattatttgtagactgtttgacaaatggaagcccacacagggctcccttgagttctgtgaagatgggtacctcctttctctgtggtctggcagtaccctgtgttctccactattagagaaaacctcatcatagcgtaaatattgaaatcttccctttattaaattgtgagtttaaggagagaggacaacttacctttgtaaccagtgcttagtagagtgttcagaacataggaatctatttgataacagtttgccaaatgggtgtgagcaagtcattctcaggatttagctgcaagatatttttatttaatgtcacacaaaatgaatcctattcttgctaatctccaaataatcacaatctgaatggcttgcttagtgataattttattcatgtaagaattatttatcatatggcatagaggatgttgtccctggggtgggggtaattactgtggaaagtaaatgactcccttatgctttttgcctttgggattgagttaccttgaatcacatgggattcaggtgtgttcctgccaagcaatttcactgccctgcaggggagctcgaattaacaggaaagagttgaagcaattagtccaaaacagtgattctccatgtgtagctctgaaagaacaatgtaaatattacttgagaacttcttaaaaatgcaatccttggtcctcagacctaagaaattagaaagtctgtggatggaactgagtaatctatggtttaatcacctgcaagtgattctgatacccacttgtgtttgggaacaacttccaaaaccaaggaaaatccagcgagttctctgttaatgaaggttcttaccatctcatgtaggatggcttcatctccaggtaaccatcccaactttgactgacttcacaattaagaagttaattatgtcacattacaaggggtccagatggagagtggattcagaatcagtgtggtgttggaccgggccccaatcccacttctctgtggttctcctcactctgccttcctttgtggattgactttgtttttgtgcttggtgaatggccatggctgttacagatgtcacatccaaaacaaagacatctcgtctggtgttctcttctcaacagttaggaaaactttcagtgaagctgcagttgaacacctcttcctatgtgttttttggcaaacatggagtcacgtgggaactcctgtaccagttctatggaaagaggtggatactactttgacagatcagttgagttttgatttttaatctggatattcaattcttctctgtgagttccatgtgtgtgagaactggtcaccagaacaggagaagactgaagctctgcctgcaagtcttgtttttgtaattttttttttttaacatacagttcacttttttggatttactgttctatgacccttttaaaaaaactttttattttgaactaagtatagacacaggaagttgcaaagatgatatggagggatcccatgtaactttcctgcagtttctcccagtggttatatcatatgtaactgtagcataataccaaaatcagaaaactgacattagcacaatgtgcatgtacagttctgtgcgcttttatcacacatgcagattcatctaactgcaatcaggatacagaactattctatcacctcaaacatctcccttacgctagccctttttagtcatgtgcaacacccccattcctaatccctggcaaccactaatatgtgcttcgtcttaatactcttgtcattttaagactgtcatataaatggaattatatagtatgtgactttttgagattgacatttttcattcagtaatatccttgagattcatctaggttgcatgtatcaatagtctgttcatttcctttatttttattttttattttttttggagacagagtctcactctcttgcccagactggagtgcagtggtatgatctcggctcactgcaacctccgtctcctgggatcaagtgaatctcttgccttagcctctcaagcagctgggattataggcgcccaccatgcctggctaatttttgtatttttaatagaagcaggatttcaatatgttggccaggcaggtcttgaactcctgatctcaggtgatctggccatgttggcctcccaaagtgctgggattacaggcgtgatccactgtgtccggccatccattcattttcattggtatggagacaggttgcttaatcattcacctattgaaggaaattttggttgtttccagttttgcactattactaataaagtttctgtgaacattcatgtacaggatcttgtgtgaacatgttttcattgtttaaataagtgctcacgaatatgattgctggattatatggtaagggtatgttcagttttcatttttattattattatttttgagacaacatctcattctgttgcccaggtttgagtgctgtggtgtgatctcagctcgctgcagcctcaacttcttgggctcaagcaatcctcccacttcagcctcctgagtagctgggaccacaggcatctgccaccacactcagttaattttttttttttttttttagagacaggattttgccatgttgtccaggctggtctcaaactcctgagcttaagcgatctgcccaccttggcctcccaaagtgctgggattataggtgtgagccatcactcctggcctgtatgttcaattttttttttttttgagactctgttgcccaagctggagtgcagtgcactctcagctcactgcaacctttgcctcccaggttcaagtgattctcctgcctcagcctcctgagtagttgggactacaagcacgtgccaccacacccagctaatttttgtatttttagtagagacagggttttactatgttggtcaggctggtcttgaactcctgacctcaggtaatccacccaaagtgctgggattacagacgtgagccactgtacctggcctgtatgctcaatttttaaagcaactaccaaactatttctggagtgggcataccatttagtcatctcaccagcaatgtatgagatatctaatttaactgcatccttgctaccgtttggtatttacattaatttttattttagttgttttaagacttgtgtagtgatatcccagcttgattttaatttgtatttccctgatggctagtgatgttggacatcttttcatggtcttatttgctaatgtgtatcttcttcactgatatgtctcttcatgtttgaatttgaaaaattcaaattataattttttctttcatgaattattctttttgttttgcatcactgtattctttattgtttttttttttttttttctgtgctaatatctttctcctcttcttcaggctcatcattgatcagaatgttagagtctttggtatggtttcatacattcctcaggctatgcttttttttctcaatcatctttttccctctgttgttcatattagatgatttttattgctctatcttctagcttcccgattctttaattttcatatacattcagttattgagcctctccagggaattttttatttctgttattttatatttcatttccgtaattttccatttggttctttttttatagccactaattctttgccaggaattagtgtaattgtttcaagagtgtttgctgtcacctaatggagcatggttataattgctttaaaatatttatctaataatttcaacatctctgttatcttgggattgccatctgttaattgccttttcctctgagaattttaaaaaaggttttcctggctcttatgtatgttggataattgtggattctctcttggatattttgaatattatgttacaagattttgggtcctaataaaatcttctgggggaatgttgattttttttttttttttttttgagacagggtctcactctgtagcccaggctggagtgcagtggtgctatctctgctcactgcagccttgacctcctggcatcagttgatccacctcagtggcccccaagtagctggaacttcaggtgtgtgccaccacaccttgctatttttttgttttgttttgttttgcttttgcttttgtaaagatggggtttcatcatgtttcctaggctggcctcaaactcctgagctcaagcaatccacctgccttggcctcccaaagtgctgagattacaggtgtgagccacagtgcccagcctgttttgctttattttaacaggcagttaacttagttggctttgctctgcaagtcttgacccattttctttaggctgtgcattcaatgttaatttaatttcaaagctgttgcagtgctattttgtctgctttacatgtgtgccacctaggggccagtctgggtcctggagagtgttcaatgttgtagtttagttctcaaagtctttgctatgttgattcttgtccattccatagctcacggatgatctcaggactttacacattgatctaaaggctctcgtctttagctccttctactctgtgatgttcctcacacatagcaattcttagggtcactctttcctggtgccctagttaggaagctggtactttagcgtttctgtgctgttgcatgcttcctatgacagcgtgcacttcagggcaaagcagcaagtcatggaggctgcggggctgctatcaccactgccaccactgcaggagtccagatttgttatgggtgttcaccggaactagggttgggagacgcgacagagctccatactgcagggactcttttgtaggttctctggtgagtgtaagagtgtgtgtttttattttttctctcccttggagccttttccatatgtcacaattccaggatttcggttgccccaaactctatgtaaggcaatatgagaggaaccaaattttaagaaaaagggaaaaaaatttactgccatctgggttatttgctgagtttgatttctctgtgcagtctctctgcttctatttacttttcaacattcttcaataacttttttctatactattttaagacatattagttgcagtaagtgggagatagggtgggatggtcttaatccatcctaactggaaacagaaccttaaatcttggctttgaagtaaaaaggtcatggtccagatataaggcaggataatttggaagaatatttatcaaattttaaaaaatttactctctaggagtctagataaatttgtctaaaatacaaatggatgagactattaggaaaaactgaatggaaatagttttaagagggaccctgtacccatctcttctcccctaccatgttatctccaaggtggagacaacacagccccaaatagcacttgggacctgagtgtagaggaggctagtgctccacttccacctgaagacctgggcggtaaaagccttccagggaatctgtgctctcatggcatgagagtggtagaatagagatgacagggggtcattgaggcagagatagtcccacggagttactcttggtaccagggatgtcaaagaacagctgagggttctctatgtctctgagaaaagggggagagaggtctcatggtcaggatgagaggtcatagcaacaaagggcctgtggccctagagacaggagcccaaatttaaatgtgggcatttcagtagagttcagcagtgagacagggagatgtggcggattgctcaggaccatccaacatcgtgaatgttggtaaggggagagatcagacctgtgtacaaatttgggagcagtgagtgcatgagtggtatggtatttaaagccatgagcttggctgaggtgtgggtgagaggagaaactggcaaacgctgagtccaggacactctgaagttcagaggatggaaagaggaggaggaaatgatagagactgagaaggttgggccagagaggtgggaggggaggtaagataaaatggtgaggaagaatgaagtactgtgccaaacaccactgctggggtcacgcaggaagaggttagctttggtccggctcttatatgtggaaacatggagcatggagatcacagaagaaaagtcagtggagtggtaaggacagagcttgacagccatggatttaaggtggatagaataaagagttgtggacagaaacaatatacacttgatcttagctaaaaggtggagaagcaatgacagaagattgacaattattttgaagaattctgatgttaataaagatacagtgcagtacttggaggaactgatttttattgtatggtagcaatcttagcgtgtttgtgtgctcattaaagggtgtaaaactgatgatcctgcaaagggtacgagatgcagccagtgcagcaggggggagctgtctttaggtagggacaaagtgagtcaagccattgtgtcaggagggaaggcagatggtgttagtaaagacgaggcaagctggtccatttggtggagggattctgtgaaagttttattctaactgcctctgtttactcagtgaaatatcaagccttagtttttgcatttgtaaaataaaacatgtaatacctacctattttattggtttagtgagcatcacagagggcccatttaaacatattttggaaattgcaagacattgtacaaatataatcattgtcattggctttgataaagttgttccctctctttggatatcgatgttttcttcctgaggtcctcaggattctagaatgttgatttgggaggcatcagctcctcaccgccctagcctgacaacaactcctttagggtgaattctcttccctcatccttacactgaaggaatggtaatccataagtcctattgctaattgaattttagattttgcattatattctgccatcctatgctttcaaattagacctagaggctctgacaccagagtaaacagacattgcatttcatattctcacctggagaaatacaattttgcttgaatggaagatgcaaggagcatggtttaaacctcagattctctcaaagagatgaaaaggagaattctactcaatgcccttaaaatctaggtgttggcaactttcctttcaatggataaaagtaattgttagtagacttttgaggatttcttttaaattttcttagctcagtggacactaaatagcattaaaagttgaaaaccacttgtccctatccatttattatcttttgaagagacattctttagacagaagttgaaattatgtttttttattagtgtaagaagggaaactaattcagattaatgagaaattacagaaattagcaagagagaatttcagcatcagaaaaaagtaagttatttaaattacctttgaggcgattattttcaagatttataaattacaattaaatatgaagcatttgagtcatgaaagttctttaagctatgaaacttctaattgcttattgcccctaattttaataaagctttttaacagagacaaagaggcaattttacctgaaaacacggaatattttacttacaactttgaaaccacattaccataacctttcaaaggaatcagtcaagtgtttcttgatcatctcatgcattcaagtcgattgcatgctcatctgacagtttgctaggctctttgggaaccactcagctctgaccaactcaatttatgtttgaaacttattccatccaagcagcattagacttaagtgtagctgggaaagagataagttagatttggcctgcaggggcctttgttcttcattcctttctttcctggattaagccctcctttcttccttccctctctggtctgtgcggggcttcatgtactcttacccatccacttctctaaggaataaaacctccattcaaataatcaagtagaatggcttcagtttgaaaaggtggggggtggtagaggggcaaaaaagagcagagactgggagcaagttttgttattagtcataaagccaaatgttacttttgtaaaccaatatgagatgtcttgtgagaaagcaccagtagacatggaattctgatttacaatgactgatgcatgaggcatgcggtctgtcctacacagataatttgtgattctgtagtgagtatagagggaccggttctcctctgagggaaattcagctttagacatgatttccaaaaagttccatcctctggatcctttcatataaagacttttctgctaactccatggttttctcagcgcctttcagggtcaaaggaattccctgatctaggtaaggtgtgagcatcaaccttaaattccttagtaagactcatcttcaggcacccaaatgcaagtttaggttgcacatcccctttttaacccctttgtgttagtccgctagggctgccataacaaaataccgcaaactgggcagcttaaacaagagaaaactattttctcacagttctggaagccagaagcccaaactcaaggtgccactaaggttggttcctggtgaggcctctcctcctgacttatagctggccaccttctagctatgtcctcacatagcctttcctctgtgtgtgtccactcctgctctctcttcttttcctgtaaggacaccagtcttatcaaattaggtaagactaagctttatgatctcatttaactttattgacttccctaaaggctccatatgcaaatacagtcacattgggggttagggcttcaacattaaattttttggggaaggcaattcagtccataacaccctccttcccttcttggactcttcttgtgatataggtttcatagtaaatgtctcatttcctaatcaccgttgaactagcaaaccttcgcttttgtgcattatagtagaagagagactgatgaccttgctttcgtggctttctcctttgattgtcatggctgcatatggacttttaatgctttcctctttgcacatcatccactgagtagagagttgtggaagaggtggttgctgaggcaggtggctgacatcagggaagatggcaagaagtgagtcagtcttgggatggaagaatctgggagcaggtagcattaggagaatgagggttgtattaagtatttagtcacatttcatccatggtgttctcttcatgttgtactgattgaaacgataaagctgtggatggccaaggtcacgctggtcattaactgcaggttggacctggaactcccacctggatgattccagtgccagaacctgacttcccttggaaatccagctacttactattccccaaacctcccacctccactttttcactacccttggcttctcctccttctctccttctttgaattatgtcatcattaattcctttgtactttttccatgtctcagcccctgccaaaggcccttattcccttctccttggacagttgtgatagccttcttcctgctggccttcctgcctctaagctgtgctaaaggggaggtggatagttgagatggttatttacagagaaagggaaggacagaaagcagggctcccaggattctctatggacaaattctgttctctttcagccacttgtatcagtgaggcatcttagtgagataagagagacagagagacagagagagagagagaggcagatgctccttcctgatgaccatggcaggccggcctcaaatcctgactcagccattcccctagaagctggtttttatgaaccatttggtggactatgtatcaacaggatcaacaagaaaaatacaagttaatgttgcatattataaagagataaattttaatgtagaaaacttctataggtgatggaagagccaagaagccagggaggcaatggtgaagtgactcagaaatcggcaattagggtaacaaatggccaatgggggctccaggctggaggaacaagggcaggagatggaactgctgcaactcagggtcacttatgcaggctggagccctgacagggaagggaagtgcagggggaaggatggagggtggaggagaggagacagggaagagaatttctctagagaactctgccacactggccgctttaactcactaacacccacacacaactggctcagctcagggctgcttgtttctgctcaccaaggagcccaccagatgctctttgctcagggggttttgacacatgtggggttccagggcccaggctgcttcaatcttgttctgccatcccctagggcctctaatggagagaggagaacattgactgacactgagggcctggacttggaagtgacaacggtattcccctcaccttcagtggcaagagtgagccacttggcccagtgcaagggggctaggaagtcccttgctgagcatcgccctgggcagcggctcagcactgtgtgaggagagtgccatcctaagggacattggtcacctctgcctcatggcttagatactattttgcttgtgaaggaaaccaaaatatttcatatatatatatatatatatatatatatatatatatttggaaatatttagagatagctattctgagggactggaaatacaagagtagcagaaaagctgtccttcttgggaagagctgtatctgtggagaaattctgcatcccccttcttggggtaaacagaacttacagtgtcttttatctagtctgccaggctgcctggttgctccctcaggaataacctcctatgtgtctggatcatataaaactgtctgcagttgctcagtgttgagatgtgggtcccacatcaatccaaatgtatgcttttctgctctgtaacatttaaaaccaaagatactgcccctaaattggtcactcttgtaatccattttagtaaagatgtctcaggaagctgatattactgatctacaaaatggaacaattccttcacactataccatttggtttcaatagttagttggttcgcccttccttcatattgattattttcttggtaaccacaagtctcagaggtactttctgttgttcctgcataatattttcctttgttgttgactttgaggctagaatcctgagctcagatggaccacatctgagtttgatccagcttcaagttctgactcagcaccctcttttactttcattttagccattatagataacagtcaccaaaagattgaatattttttttttccttattagtttgcatttccttatgtatccaaagaaacaattcctggagagtaggatccatctctaaattccattggtaactttcacctttagtaattgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcaacttgcattaagcttgaagtttttttgccaaaactaaaaactcctacatttttatatgagatgggaagaagcatcctttctattcttcctacccacagcttgtttacagagagcggtgtctggaagcttggctgtgcatcagggttatttccactcagtgaatggggaagcttgtgaatcctgcagctatatggctgctcagagccattctgccttgaaacatgagtactgaccctggaagaaaggtgttagatataaaggtttttccattttgtttgattctttttgtctgagcccttagatctcctttaaattaatagcaaggttaataatataataatatgatgttatatattacaatttcaactcaacaggaattccatttctggtagcaggtatatggactcatttcttctttgcatctatttctaggttatttgcagccccgagatctacccagctgtggtgttatcccctttgttcaaagccttctttgtaacactggatcaaggtgtaggaacttcagctatgaagggtcaatggagcatcattttcggtaagagaaacacaaagatctttttcagaaatctcagaaagctgatacatagaacaggcttctgctttttgtaaagcctcaataatttgggataggtcagagatcatgagaagtatagaaattaaagttttattaaattcagagtcatataattctgcctccaactaatggttagcttccagcaggagatctttccactgtcacttgcgggactcacagagtaataactgattagcaaatgccatttgcatgtaataatttgttttctgtaggttaaaactcttgacttcaaaattacttgtctagccaacttttcattttagtgccacatgcccccagaacaattattttttgagctacctactgggttttttctcctgtgctactagttgactagaatcttgtcgccagctgagggaaaataaaactgggcagtaactctttatttgtcataaaccacctaaacggactacaggacagttaagttgccttctctgagtctctgaatgctgagctatgcctgtggttgcctacagtgtcagttggccttaaactcaagaagagaaggagaagaagatatttcatgtgagaagagacaaagtgagggggtttaacttgggggatcctgaatgccctggaaacttctcccaggtgaagttaggaagggaaggaagtggctagcggattaagatagtttgaatttatcaggtatgaatgatctgagttttatttaatctatatttactaatattaaacaatctaagatatttaaatgtaaagcaaatgttgacatatatgatctttattttccaactctaagttacaagaggaaaattaaaagtttccagataattttcggcatatcaggtacaatatttataaatggtgttgttttagttcatttgggctgctataatgaaataccataaactgtgtggcttataagaaacaaatatttatttctcatagttttggaggctgggaagtccaagatcaaggtgccagctgatctggtatctggtgagaaccctttccattataaatgacaccttccagctgtgttctcacataatggaagggatgaggcatctctccagggtctctttaatacgggcactaatcctattcacgaaggctctgtcctcacgatccaatcacctccgctatatcatcttaggggttatgtttcaacgtaaaaatttggggatgggagatgccaactttcaggtcatagtaggtgcttactttttctgagacaaatcatatagaaatatgatataaagaggctcatttgaaaatactgtaaagtgataaccctgaaaagttcaatggtcttttcttgaatgtgtggagaagggaaatatacaaaactctgtctttcttggaagcattagaagagcttgagacttagcagtgtctttatttcaagtctttcttatgtctcttccttacttggattgggaggtttaaatgatgttgaagtggaaagaatatgattttgtggctaaacaatactggctctgttacctgtggttctgtgaatctgtgcaaattaattgacctctttgaatctgtttactcacttcaagtgttgtgaatgttaaagacaaatatagaaaacatctagcgcaatgcatggcacagaggcattcaaccaatgggagttgataataacaaattcttattactacggctgtaacaattataaaaatactacttgaaggccaggcacggtggctcacacctgtaattccagcactttgggaggccgaggcgggcagatcacctgagatcaggagttcaagaccagcctggccaacatagtgaaacccagtctgtactaaaaataccaagaaattagctggacacggtggcagatgcctgtaatcccagctattcgggaggccgaggcaggagaattgcttgaacccaggagggggaagtcgcagtgagccaagattgcgccactgcactccagcctgggtgacagagcgagactcattctcaaacaaaaaaaaccccccaaattacttgatatcaggaaataatctacctttgttttctttgtgtttttccacatcaacatcctcacttcaatgtgcagaaattcaggggttataaaagcaacctggtgagattcttcacctaacattctgagagtggtagtcaggttaatagctcaccagcattgcaaagcctttaactttgagaacgaagaatgaaattcctcactttgtctggtagtgcccaagtcagaggtataagaaatacaaaataaaatagggaaaggaaattgtaaggagtaaggaaagagggagagggagaaaggagacaagaaagagtgaagcacgctgtcagtagggcctctggtttcagactcagccacttgaccaagcagatttcatgcgttttcatattggagtaagtgtggattcaattgaagttcaagcccataaataaagactcactcctgattattttgtggtaattgtctcagttaaaaaatacctgaaagcggctgggtgcagtggctcacgcctgtaatcccagcgctttgggttgttggggaaaccagccccacaccacctggcaggtaccccaagtccagcggagacaaaggaaatagaaagagaataagagttcaaaggcgggtccaggggtcctgagcatcggaggctcgctcaccgcgcagagctctcaggctccgcctactttattggtttacaaagctctttgttcttagggcagatgggagggggaggaagggatgaggaaaaggattaatcagtgaaggagaactcctgagtcattcaataagaagtatagcaatggcggtttccgtgaatttccttgagcaaaggcgtgtctaaactacttaagatctttaatttatctggactgaaatgggtgggagcgggtttcaggaggagccaagatgtttgattatactccactgcttcaagggagtgttatctccctgagcaacctgtggaatgctgcggagctgttacgctctcgggcataaagacaggaaggcagtaaggagacttttctcctcagaagctgcccatggctgtctcacacagaggagaccaactcgtctggcatcccagcactttgggaggctgaggcgggtggatcactaggtcaggagttcgaaaccaccctggccaacaggctgaaaccctgtctctactataaatccaaaaattagctgggcgtggtggcaggcacctgtagttccaactattcaggaggctgaggcaggagaagagcttgaaccggggaggcagaagctgcagtgagcagagatcgcaccactaaactccagcctgggcaacagaacaagactgtctcaaaaaaacaaaaaatcttgaaggcaaatatcacagttaatttagttcataatgtgtctggaattggtgggttcttggtctcactgacttcaagaatgaagccgcagaccctcatggtaagtgttacagctcttaaggtggcacgtctggagtttgttccttctgatgttcggacgtgtccggagtttcttccttctggtgggttcgtggtctcgctggctcaggagtgaagctgcagaccttcacggtgagtgttacagctcttaacacggcgtgtctggagttgtttgttcctcccggtgggctcgtggtctcgctggtatcaggagtgaagccgcagacctttgcggtgactgttacatctcataaaagcagtgtggacctaaacagtgagcagtagcaagatttattgcaaggaacgaaagaacaaagcttccacacagtggaaggggcagcctggctgctggctagggcagcctgcttttattcttatctggccccacccacatcctgctgattggtagagccgaatggtctgttttgacagggcgctgattggtgcgtttataatccctgagctagacacaaaggttctccacgtccccatcagattagttagatacagagtattgacacaaaagttctccaaggccccaggagaggagctagatacagaagtgtcaattggtgcactcacaaaccctgagctagacacagggtgctgagtggtgtgtttacaaaccttgagctagacataaagattctccaaggccccaccagagcagctagatacagagtgtcgattgttgcactcacaaaccttgagctaaacacagggtgctgattggagtgtttacaaaccttgagctagatacagagtgccgattggtgtgtttacaatccctgagctagacataaaggttctccaaggccccacctgagcagctagatacagagtgtcaactggtgcactcacaaaccctgagctagacacagggtgctgattggtgtatttacaaaccttgagctagatacagagtgcccattggtgtatttacaatccctgagctagacataaaggttctccaaggccccaccagactcaggagcccagctggcttcacccagtggatcccgcaccagggctgcaggtggagctgcctgccagtcccggtgccgtgcgcccgcgctcctcagcccttgggcggtcgatgggactgggcgccgtggagcagggggcggcgctcgtcggggaggcttgggctgcacaggaacccacggaggtgggggaaggctcaggcatggcgggctgcagtcccgaggcctgccccacgggaaggcagctaaggcccggcgagaaatcgagcgcagcgccggtgggccggcactgctggggaacccagtacatcctccgcagccgctggcccgggtgctaagtccctcattgcctggggcctgcagggccggccggctgctccgagtgcgggcggggcccgccaagcccacgcgcaccggaactccagctggcccgcaagcgccgcacgcagccccggttcccgctcgcgcctctccctccacacctccccgcaagctgaaggagtgggctccggccttggccagcccagaaagggactcccacagtgcagtggtgggctgaagggctcctcaagtgccaccaaagtaggagcccaggcagaggaggcgctgagagcaagcgagggctgtgaggactgccagcacgctgtcacctctcaataagtttccatgacctccctaattcctcaggtaagttcactttgggcagaaatcctgggtaccatctgatgtagcttatggttatgaaaatcagcttcctcattcctgcctttgttggggggtttccccttcattttaacaagaggatttcagagcagaaatatgaagcactgcaggcaacagaagtggatattcttgtgttagtggtcactcctattttgtttaatttaaaatgctttgtaatgcgaatgtgctgtctaaacccgaccctcacttccctttcactgtctgacaaccttcgggaggcggatcgccatacccatgctggggcactcccacccttagtctacagcacccggtgccttgccttctgggctttgattgggtgacctttcatttccagtttcttgaaatgtttccagccatttcctactggtctcatttggtggtcatcaatattttaatttatttttttctccattctcaaacatgcccagaccccctgagaatcatctgaccctctctgcctcttttccaaccaccatactgcctggttctcagccttatttgattatcacctgctgctgcctcacctcagcttctcagtttgcttttcactctcttgacactcttttttttttttttttctgagacggagtttctttcttgttgcccacgctggagtgatatgatgagatctcggctcaccccaacctccgcctcctagacttataattttttttttttttgagacagtctggctctgctgcctaggctggagtgcagtggtgcgatctcggctcactgcaacctccgcctcccgggttcaagcgattctcctgcctcaacctcctgagtagctgggactacaggcgggtgccaccatgcccagctaattttttgtatttttagtaaagagggggtttcaccatgttggccaggctggtcttgaattcctgacctcaggcgatctgccccccttggcctcccaaagtgctgggattacaggcgtgagccaccgcgcccggcctatccttgtttcttaaatggctttcctgacatggagacgtaacagcattagattcgccagggagaaggattccttctgtgcctgccgtcccattccgatgctttggggccctccacaatgatgagtactcccctccccttcctccgcaccttccaccgcatggtcggcctttctctttttgtattccccatctgtccagcccttacacagcccaaggtcttcctcttctatatgcagtcagctctgtcgtggtcagctacctgctcgcgatgcagcaccatggcttctgcacactgaggaaagacagctccggatgggtctggggtttatttcccagcccctttcataacttagtggagagctggcccaggaggggtgagtgaagaaagaaaaaacgatccaagctcctgagcccagagtctcccctcctgacccagccacttgcctaaggaagccctccctgtaactgcagtcacttgtctacctgcaatagagcattttagggctgggtctctgtcctggggttctctccttgccctgcctaggcatgtctcttgatggactgttgaaaacttgggaattatgtgctttttgctaggtttttatttttaaatttctcctccaataaaacttattttatttttacaccgtgtttagtatttcaattttgttttctttcctacttcaggttataaagataatttcttacattattttcttaaagtattatagtttttcctttcacccgctggtctggaattcatctgggttttacgtctatgtatggtgaaggtaatgatttaactgcattttttttccatttggataagtattttttcagttgtattattaaacagtttatcaatttcacattgatttgtaatcccattgtgacatgaattaagtttttgtatgtggtgcatctgcgtctggcttctccaacttgttatagccccagccattccttgaactataccctgctgtcttactgtagctttctaatgtcttgatatctgaaggagtaaatgtctctatcttgcacttctcctttagggaagtctttgttcttccatgtaagtgtaacaaccttgttgtacaagtcagtgaaaaatattattgggatttttattggagttgcattgcatcttgagatcctgatgcattatttaatttatttaggttttctttagtgtctttcaacatagctttatagtattttttcatgaaggttatgcatatctttcattaacttacttccttgttactttatatttgttgttgctattgcaaatagtattttttaaaaagttacactatgttacttatcattgcttgtgtaatggaaataaagttaattttaaaaatcaactttattgatctatacaataacatttaagagtacatttcaatgaatttgacatgtctatgcacctgtgtaaccaccatcatgattgaaatataaagcatcttcattttcctcagaattctcctgtgctctatcccagcccaacctacctccactcaccccacatcttcagatccaggcaatagcttgtctgcttttggtcatctagattagatttgccttttctaaattttatataaaggatatatccttggtgtttggcttctttcacccagtaaaatgttttgagatttatttatgtggttggttgtattagtatggtcatgcaccacttgacaatatttcagtcaacaatggactgcgtatatgacaggggtcacatagaattataataccatatcttaactgtactttataaatgtgtagacatgcaaatgcttaccattgtattacaactgcctacagtattcagtacaatgacatgctgtacaggtgtgtaggctaagagcaataggctacaccacatggctaggtatgtagtaggctccaccatctaggtttgtgtaagcatgttctgtggtgttcacacatgatgaaattgcctaagaatgcatttcccacagtacattctcttctttaagtgacagatgactataattcattcctttttatttttcccatgggtaaggatgacccgggatgttcttttctgtttttttggttaatttttaaaaaaaattttgtttctgaatatatattttaaaagtctttatttttaattattgtggatacatactagttttatatatctctgaggtatgtgcaatattttgatacaaatacacaatgcataatgataaaatcagggtaatcaggatatccatcatctaaagtataaatcatttgtgtgagtgtgtgtgtgtgagtgtgttaggaacattccagtttcactcttttagttattttgaaatatgtaataaattattgttatctatagtcatcccagtgtgctactcaacattagatccaactccttctatctaactgcacttttgtacccgttacttatcccctctatatctcccacctcaccactacccttctcagcctctggtaactatcattctactctctgtctctatgagtttaattattttaagctcccacatataagtgagaacacataatatttgtctttctgtgcctggcttatttcccttaacataatgccttccagttgcatccttgtcgttgcaaatgacaggatgtcattcttttttatggctgaataatatacgtactacattttctttatccatttatatgttgatgaacactaaggttgattccatagcttggctgttttgaataatgctgcagtaaacatgagagtgcagatgtctctgttttttttttccttttggattggatttatacacagcagttggattgctagatcacatggtagttttatttctagttttttgaggaacctcccttctgttctccatagtggctgtactgatttactttcctgccaacagtgtacaagagttcctttttcccaacccctcactaacatttgctattgcttgtctgtttaataaaagccattttaactgggatgagatcatatctcattgtaatttggattttcccttcttggatgagtagtgatgttaagcaagtgttcatgtcctagtgacccatttgtatgtcttcttttgagaaatgtctattcagatttttgcctatttttcattgaattgtttgtttgttttgtattgagttgtttgagcttgttatatattctggttattaatcccttgtcatatgtgtagtttgcagatcttttctcccattctgcgagttgtttcttaactttgtttgttatattattttctttgctgtgcagaagcttttgagcttgatgtgatccatttgtccatttttacttttgttgtctgtgcttttgaggccttactcaagaaatctttgcccagacctatgtcctggagtgtttccccaaagttttattctattagtttcatagtttcaggtcttagatttaagtctttaatcaattttgatttttttttaatatggcaagagataggggtttagtttcattctgcataaggatatccactcttagcagcatttattgaagagactgttctttcctcattgaatgttcttggagcctttgtaaaaaatgaggaatttaatgcttggatttatttctgggttctctgttctgttccattggtctatgtgtctgttttcatgccaatactgtgctgacttggttactaaagctttgtagtatattttgaaatcaggtaatgtgatgccatcagctttgctctttttgctgaggattgctttggctattttaggtctttgtagctgcatataaattttaggattttaaaaaatgaattttttttctatttctatgaagaacatctttggtattttcatagcgattgcattgaatctgaagattgctttggggaggatggacattttaataatattgattcttccaatccatgaacacggaacatctttctaactttttgtgtgtcctcttcaatttctttcatcagggttttatagttttcattgcaaggattttttgcttttttggttaggtttattcctaggtatgttattttatttgtagctattataaatggtattgctttcttggtttctttttcacattgttcactgttagtgtatatacatgctattgatttttctttgttaattttgtatcctgcaactttactgaatttgtttatcagttctaatagtttcttggtgaagtctttaggtttttctaaatatgagatcatgttatatgcaaacaaggataatttgacttcttcctttccaatttggattccctttatttctttctgttgctggattgttctggctgggacttccagtgttatgttgcataaaagtagtgaaagtgggcattccagttccaaatcttaaagaaaaggtcttcagttttcccctgttcagtatgctagtagctgtggttttgtcatatgaggtgtttattgtgcttgattgtgttccttctatatccagttttttgagagtttgtatcataaaggaatgttgaattttatttaatgctttttcaacatctattgatatgattatatagtttttgtcctttgtcttttgatgtgatgtatcacattgattaatttgcatatgttaaatcactcttgcatccttgggatggatgaatcccacttggtcataataaatgtaatattaaatgtaatattatatttacatgtaaatttaaatgtaatattaaattcagttaaatgtaatattaaattcagttttgttggtattttgttgagaatttttgcatctatgttcatcagaaatattggcctctggttttcttttttgttatttttttgtgtatatgtctggttttggtatcagggtaatactggcactgcagaacgagtttgacagcattccttcctcttcaaccttttggattagtttgagtaggattagtattaattcttgtttaaatggtaaaattcagcagtgaagccattgtttgggtcctgagcttttctttgatgggggaatgtttattactgttatcttattacctgttgttggtttattcaaattttggatttctttgtggttcaatattggtatgttgcatgtatctaggaatttatttatttcttctaagtttttcagttgaagaggacacacaaaaaatagaaagatattctatgttcatggattgcaataatcaatattaataaaatgtctatgcttccaaaagcaatctgcaaattcaatgtaatttctaccaaatcgatgtattgatatatagttgctcacagtagtctctgatgatcctttgaatctttgtggcatcagttgtaatttctccttttttgcctcaaactttatttatttgggtcttctctgttttttcctatgtcagtattgctaaaggtttatcaattttgtgtatctattaaaaaaactttttgtttcattgatcttttaaagaaaacttctgctctgatctttattatttcttctactaattttgggcttgttttgttcttgcttttctaattctttaagatgcatactgtattagtcaattcttatgctgctatgaagaaatatccaagactgggtaatttataaagtaaagagatttaattgactcacaattctgcaccgttggggaggcctcaggaaacttacaatcatggtggaaggggaagcaaacatgttcttcacatggcggcaggagagagaagcatagagcaaagggggaaaaagccccttataaaaccgccggatctcatgagaactcactcactatcatgagaagagcatgggggaactgcccccatgatctaattacctcccatgaagtccctcccacaacacatagggattacaattcaagatgagattttgggtggggacatggccaaaccatatcacatagttaggttgtttatttgaagttttttttctttttttaaaacttttgtgatgtaggcatttattgctataaacttgcctcttaatactacttttgctgtatcccacaggttttggtacgttgtttttctattttgatttttttttaaacaattttaaaatttccttcttaatttcttcattgacccagtggtaattcaggggcatattgttcactatttctgtgtttttacaacttgcaaagttgatcttgttattgatatctagttttattccactgtggtcagaaaagatacttaatataattttaattattttgaatttttttagacttattttgtggcctaatatataatatatccttgagagtgttccatattctaaaaagaagaatgcagattctgtagctgttggatggaatgttctgtaaatgtttattaggttcatttcatctatagtgtagataaaatcaaatgattcttcattgcttttctgtttaaatgatctgttcaatgcaaaatatggggtgtcaaagtctccagctgtgattatattgagatctctctctctttagctctgttaatatttgctttttatatatggatgctccagagttggatgcacccaatttatattattatatttatattacatttcgctgtctgagaggtcacatatctctgtcactgcaggattggtcactgattacttagtttgtttggtgaggttgtgtttttctggatgttcttgatgcttatggatgttcattaatggctgagcattgaagagttaggcatttattccaatctttgcagtctgggcttgtttgtacccatccttcttgagaggactttccaagaattcaaaggggaataaatgttgtgacctaagcctgtggtcactgcagctgtttcagcactagctgtttcattcctaagcccaagaatgctgcaactcttgaagactcccagataatcagccttgttggacttagggaagttaagagagcattctctgggttaccagttgaagtctcttgctctcttccttctgtttcccctaatcagaaggagtatctttccacactgggctgcctggaattgggggaggggtgatgcaggcactcccatggtaccatgttgggtcacacctgaagctcatgttcttcctgatgagtacagtactggggcttacccaaggcccatggccactacttcctggctgctgctgatgtttattcaaggttcaaggtcaccttactcagcaggtggccaatcctgctgggactgggtccatcccatcagggcagcagattctcatctagcctagatgggtctagaaatgccattgggaagcaaaggcctggaatcaggggcttcagaaatctgcctggtactttattttacagtggctgaactggtatccagcttgccagaccaagtcctctgtaatattccttctcccttcctcaagcagaagtctttccccaagctcactgcctggagttggtggagggttgatgtaagcactctaatggctactacagctggtattgcattggtactgcaactccactgccttcaaaaccagcagaacaccagggcttatctaaggactgcagttcttgtggcctgcctgccactcaaatttatttgggatctcaaaccactttatcagcctgtagtgaggccagccaggacttggatacctcttgctgtggcacaggatgctcatctggctcagggctggtctaaatgctccctctgtgggcaccagtagaattctgccctttgttgcattctattgtgatagggcagcactgagtttcagtacaaagattcacacttagtttgctctccctccctcaagcacacagaatctttctccatgctgcactgcctgggattgagtgaggagaggtaggcaacgcaagactgtcctttctatcttcttcagtgcctctttccatcttaaatgttatgaacattaaaaaataaatctgtgtgtggacaaatattttaatttttcttgggttaatacctaggagtagaattcttgggataaatgtttagtgtatgtttagctatatagtgtatgtccaggctgtttgttcgaaagtgttgtgcaattttatactcccaacatcaatacataagaattccagttgctccacattcttgctaacacttattatgttgttctctttaattttagccattatactgttgtattgtgctttctaattgtagttttaatttacattttcttgatcaggaatgatgttaagcatctttttatgtgtttattggccatttcaatattttttgaggaaagtgtctgtttaaatattttatgcaattgattttttatttttggttttattgaattcttagagtttttttacatatactggtcacaagtctttaatcatatgtatacatattatacatgtattgcaaatattattttctcatttgtgctgtgtcttttgaagagcaagggttattttgataaaatataatttatcacttttttctattttgagtagtgctttttgtgtttttctttaacaaagaaatatttgcctaatatttttgaagattgttcagattttttcctgtattttctatgtttaataattttagcttttgtttataggtacaatttattttcagtttatttctttctatggtgtgatgtaacttttgaggtttatctttttacatatgtatatacaattctagtagcatttgttgaaaaagctattctatttcattaaaatacattgggacctttgtttaaaatcagttgatttgttaatagtatgaagggctgtttttggactctcagatcttgtaggtttcatttcacaacatcagaatatagcaaatattgcaataaagtgagtcacataaattttttagttttccattgcatataaaagttatgtttacactatattgcagtctgttaagtgtgcaatagcattgtctaaaaaatgtacataacttaaataaaggaacactttatagctaaaaaatgctcatgatcatctgagccttcagtgagtcaatctttttgctggtaaagatcttgttttgttgccgatgactgctgactgatcagggtggtggttgctggaggtggaagtggctgtggctatttctttaagtaagacagaaatgaagtttactgcatcattgactgtttctttcatgaaagatttctctgtagcatatgatgctgttttatagcatttacttacagtgggacttctttcaaaatgagagtcaatcttctcaaactctgtcactgacttaccaactaactttatgtaatattctaaatcctttgttatcatttcagtaatgttcacagcatcttcaccagaagtagattccatctcaagaaaccactttgcttgcttatccataagaagcaactcctcattcattagttttattatgagattgcaacaattctgtcacatcttaaggctccacttctaattctagttcttttgctatttccatcacatctgcagttactttctccactgaagtctggaacccactcaaaatcatccataaatttgaatcactatctatgactctatagctttatgaaattcatttcttaaataataagatttgaaatttgaagttacttcttgctccacgtgctgcagactggatgtttgttagcaggcttgaaaacattaatctccttgtacgtcttcattggaactcttggataactggctgcatggtcaatgagcagtgatattttgaaaacaacatttttttctgagcagtaggttttgacagtgagtttaaaatatacagtaaaacatgctgtaaacagaggtgctgccatctaagctttgatattccatttatagagcacagaagcagttgatttagcatagttcttaagggccctaggatttttggaatggtaaataaacactggcttcaacttaaggtcaccagctgtgttagcccctaacaagagagtcagcctgtcctttgagactttgaaggtaggcattgacttctcctctccggttaatgaaagtcctagatagcatcttccaatgcaaggctgtttcatctgcattgaaaatctgttgtttagtgtagacacttacaccaattattttagctagatcttctggagaacttgcttcagcttctatatcaatgcttacatcttcaccttgtacttttatgtaatggagacggcttctttcctgaaacctcatgaaccaacctctgctaacttcagactttccttctgcagcttcctcacctctctcaggcttcatagaactaaagagaattaggacctttctctggattagactttggcttaaggaaatgttgtggctgatttgatctatccagacctttaaaactttttccatatcactttcttatcatttgtgttttcactggagtggcacttttcattttctttaagaaccttttctttgcattcacaacttcattaactgttagtgaattgcatttattaactgcttggtgaaaaagtcctagctttcagcccatctcagcttttaacatgctttcctcactaaacttaataattcttaatcattaataaacatgggaggtggaggttgcagtgagctgagattgtgctactgctctccagcctgggcaacaagagtgagactctgtctctaataataataataataattctaataattctagcttttgatttaaagtgacagacatgtgactcttcctttcactcgaacaattagaggtcattgtagggttattaattagcctaatttcaatatcattgtgtctcagggaacaggaaggcccgaggagaggaagagagatgggggaatggccaaacagtggagcagtcagaatacacacaatatttattgattgagttctccatcttatatgggcatggtttgtggcatccccgagcaattatgatagtaatatcaaagatcactgattacagaacacaatagcagatataataataatgaagatttaaaatattttgtgaggattaccaaaatgtgacacagagacacaaagtgagcacatgctgttggagaaatggcattgatagacttgctcagtgcagggttgccatgaaccttcaatttgtgaaaaatacagtatctgtgaagcacaataaagcgaagcataataaaacaaggtaggcctgtacacaattcaataattgttagtatattcagagctgggcaaccatcatcacagttaattttagaaaaatttccccaacctgacaagaaaatctaaatgtattagcatacacttctcatttcctcccaatctcccccacgcctaaccctgggcatacaactaaactactttctgtctcgatagattttactattctggacatttcctacatatagaatttgtataagttataggctttgtttggtgactgccttctttcacttagcacgatgtttttaaggttcattcatgttgtagcatctaaaatccttcattttaaaattgatgatcaactaatattcccttgtatagatacaggacagtttctttatcttttcctctgtcgaagtacatttgagttgtttccacttttagcctattatgaataatgctggaatattcatgtgcaagttttaaaataaatgtatgtttttgtttctcttgagtatatgctaggtcatatgatagctctacgtctaacattttgagaaaccgtcagattgtttttcaacgtggctctaccattttgctctcccatcatcagtggtagaaagcttcaattactccacattctcaccaatacttatatttctgttctttagattgtagccatctaggtggatataaggagttatcccattgtgattttgatttacatttccctagcggtttatgatgttgacaatctttttatgtagtttttggccatttgtatatcttccttggagaaatgtctattcaaatcttttgcccattttaaattggattatttgtctttttattataaagttgtaagaattcttcatatattttacagacaagtcccttattagatatatgatttccacatctttcccccccattttctgggttatctttccactttatgattgtgtttttgaagtaaaagtttttaattttcatgaagtccaacttatctttttcttttgttgtttgtgcttttggtgtcatatctaaaatgctcagcctaaccttcaatcataaggatttcctgctatgttttcttctgagttatacagtttagcttttacattttagtctattatccattttgagttgacttttgtgtatggtgtgaggaagggatacaacttcattcttttgcatgtggatatgcagttgtcctaaagggttaccttctatctatagattagtttggagagaattaacattttaaaaacattgaatcatccaatccatgagcatgatatagctctccatttattttaagctttctggaatttctctcaggaatgtttttgtagctctcagttctatgtatatttcattaaatgtattcctaagtagttaatattttttggtattgttttaaacattttgatttctcaaagaactaagaatagaactaccactctatacagcaatttcattactggatgtctatccaaaggaatataaatcattatattaaaaagatacctgctcttgtgtatttactgtagcacaattcacaagtgcaaagttatggagttgacctagtactgtcctcagatccttcctctctggctcagatgaatgggagcagtaatgtgagtcagccataacaaccttcttaggagaattacttctgcctttggatctgcttagagataattctcatttgataacaatttgccctgtttgtctaagcaaaaattaacaaaaattgtaatagaaagaataatcatattgcttcacattccttgcttattcttgtagtccttacgctgaaaatgcacatatctcagtgttagtctcaccactgccgcttctcttcctgcttatttacacagtgctgggtgctggatgatcctcacaccaccctattaggtaggtaatattttgatcttattttaaagataatctcccaagtgtgacactgctttaaacacattttgactccaagggagctctcattgggtctaagttttctcatcttcaaactgaggaagggacctgaataatgatttccaaggccccatgtacttctgacaacctcaagtgggtccttcacagaattgcaaggatgtctctaggtgcagcattggttcctggccctttgaaggggtgattctcagtgtcagtctgagggctgggaaagttcagtcatctctgcccagtggccttctcttgatctccccactgtaatctcttttatccccttccctttgcaagtcttttcctagcctggcaggtcaagcattacctgataaaagtctcaataaagacctgtactcagaaaggaggaaactgctctccacccaaatcctattatagctctgggatttccctgctgctctggaattcactctctctctcacacatacacacaaattaacatttaatcaggattttctatgtatttttctgctataaacatttctcatgttaatgatagttcctaatttggtcttaaggacaaattgaggtacttttgagataataactagaaaaagaatgtaaaacctgctcattattacaggggaaactcatcttgaattacatcagtttctataatctgataattctatggtttccgaggcgaatctcatgtatgggtgaggcaggagagtttgaatcatggttcatagctttcagaggtcatttttagcctttaatatgaggcctcagtagagaagtaatttcttgttgtgcttttgaaattctgatccattcaagttgaaggccacacttaaaaggtaagatttctggctggtcatggtggttcatgcctgtaatcccatactttggaaggccaaagtgggaggatcactggaggccaggagttcaagatgagcctgggcgatatagcaagatcctctctctacattttttttttaaagcaaagcaaaacaaaacaaaaacaggtgagatttctgttgagtgtacgtagcaaccacctgtagtagaaggtcctctaagccagtgctcagttctctgggctccagacctagctttgctgcaaacattctgcttgcttttagcaaattcactttgattgtctgggccacatttcctcatctctaaatagctgacttgaaaggcattgaatttattttattcatcagtaaatgttgaacctgctctgacttcattataggttgtgagaattaagtgataatatttgtggaagagatttactgtaactctttgtgatgtaagctttgttattttttcatggtagatatgcatgttgacaactgttaattcattttgactatgttctctaatttgtaaaataaaggcatggaattaaaaaactaaaacattctccgtaattatctctgtctcctcctcatgcacagatcatatcatgtccgtactgttcactgatgtatttattccaggcaccgtgtgcagggcatgctgtataatatgtgttaaataaatttaaaaaatggcttataaacataaaatggctaagctttcagataatacagagaatgagaacgattttctaattttaaatttgtgaagattttttaaataatgatttctcttttggatgagggtcaggtgaaatgggctctcagggtagatgatgagagtgtaagttggtacaagtttaattgaaagcaatttggtatcaagaatcttaaaaaatgccaaggaaacttattcttgttaaagagtttcacttgcagtatttattctgtttaaagtttgtctaggttccaaactgcagctgaccccaagaaagtcaacaacctggcctttttaaaagagatacaagacctggcagaggaaattcatggaatgatggacaaggcaaaaaacttaaaaagactttgggtagaacgatccaacactccaggcaagtaaacctctcataactgtgacactacctacctggacatagcttaaggagagctgtggaggctatgagaacccagaatgctaaatgctcaactcctgcctgtgctaaactttcatagtgagtctttgatggatgaggccagcacctgcagacggttgtggagggtggagctggattctctctcctcaaccccctcggaaggcaccttgtgcagtgcacacactgcataaccttcagagggctgcagcccatcctgactttgtctccacagttaccttctcaccactctgcctactcctttacactcttcggctgttgtcttcctttcttgctttctcttattctgtttttaaaatctgtccccaccttccccaaacacacacacacacacacacacacacacacacacacacacacacacattcccaattcatttcctccttcttgtatatttggattggtcttttccatgttagtaaccctttaagactggccttggatgatttatttactttgattacaaaccttttggattattggggtggattattccctaaacaaaagcaatttctgtttattataaagaacatccacattataaatggcttcatcttatttataatctatagtagggaaagttaggatggataaagatcttagagagttttgcttacaaatggagaagtttgcacctcagaaataggcagccagttgcctctcttcacatccctgagtcattgcctattgtgatatttgttaataaatgggggcattcagttaaatttgaaatttaaataacaaaaatttgttaatatatgtatgtcccaagtgttacatacttgggtaagaaataatttatttctaatctgaaattgaaatttaactggatgtgttctattttaaatttgctaaatctgataatcctaagtatatagctccaactataattcctatgtaattttttctttcttcatggagtgtatacaaaaccacgaaataaagagtttggcagaaacatgaagaatgggcttcccaaggcagatggcattatgtggtatttttaagagacaaaatagcacctttgtccaggatggggcagggctggccatggcctgcctgaaagctgatttcacaatggacccaaaatgtatcaaaatagaccagaatggttccaaacaccaaatgatggagttcttatattacactctattttggggtcattctacttttataaaatttgattttcaaatgaggtttttaacatgctatttaaagaagaattaaatttttttgagatgaagttcccactttatttctagttttctattatttgagccattttctgtgagatatgtaacttaaaataatctgaaaaattataatttcacttttttctcttcaagtttttccttcatttttttctttttaaaaaaattttcatttattccctctctcctatcctgaatttttgcaatgcccagtgaaattagatactaattaaataatacaataccctttggcaaattgttgaaatttggtttaccagttaaattttttccatgaatatacttagatttggaaatctatggtgatagctttcttcagataaatcttatgaagatagatttattcttcagttttggtgtatttgatttttgggccagggctcttggatactccatttgactttagaattaaaagtaggcatttagcatgtgctttttcattgatgattgaactaatatctcttaaaccttctttattatagattcttcttatggttccagtttttttacagtaagtatcttaacaatagtttgaaaattagtcttcagagacagaatggttaagtttacaacactgtttttaagtttacattttcaaagattatttctaatgacttgtataacaattgtatagaagctggatttgagagagccaaggtctttgtagatacgggctaaaagacaagtttgaattttctgaagcaaggctctgggtctgtgaaaagcagaggtgaaacctgaggccagcaggtggtgggcgatccacagagttgctttgtaagatgggtacagagtttatctgatcccagggatggtctgagatttgtgcttggcacataagcggtgactccctcgaggcacgaagccctcagttaaggaactagttatcaacaggggggattttgacctccaaaggatatttgtcaatgtctggacatatttttggttgtcataactgtggaccagtggggagggtaatattaacctctagtgggttgaggccagagatgtcgctaagaatcttacaaagcacaagacagcttctacaacaaagaatcatctgacccagaacatcagtagtccggttgataagcctcaagttaaggtgcaaccctgacaatattaaaaattcttccttgctcatattgcagcaccagacactgactgactgtacaggactttgtagtaacattgcattaacagaagcatatgtgtctgtatctgtttaattctaagaaagatttagacagctcaaaaaaaatatgccataaaaccattaggagaaaagtaaaagaataggggccagctaatggattggaatgaagcaagaatgtcagtgcatccattaaataatgacactagcaaagagtattgaacaaacactcatcttaacttggagatttctgatgcaccaggtcaaaaggaaaatatgggacacacactcaaaatcttacaaataatgaaagaacttaaaaatagaataaaccatcactttaatgattaaattagcatttaaaaaagaaattataatacctgatgcttgtgatgttgtagcttactgatataatctcatatggttgtgacaatgtaaaaagatataataatttttggaaaagcaacttgattttcttgctctgtaattgttctgaaaattaatgttatgtataatacaagggaaataaaaagctgtatgcataaaatgttcattgataatgatggataattcaaatttcccaaagtaagataagttgaccttggtggccttcttagtacagtcacttaatagtgagtatggtatgtggaaaatgagtatgttattagatcaagtgtaaaaagcagaggacagtatcatatccatcgtatgtttgcgatgtaaaaacatttcggtgcaaagaattgaaggaaaaaagatttgttacaatgaaagagttctatgttgcttttttattatagaattctgataaagatgttataccgtttgattttcactgagagtgaaatggctatctgaataatctgagcagaggaatggtgggacttgagttatgtttttggaggatttctttggacattgtgtcaagcagagaccgacggtagccagagcggaagtgggagcccacgtagggaatcagctcatccttctatgcaacattaaatggaggtattttagaacagacgcacagttagtgagggaggtagtgagatgtgagggtggttttgatatattttggaggtaaaatcagtaggctctgttgatgaatgtgaggtaggttatgagagaaagagaagaatcaaagatgactctatgtggtttgacctcagtaattggaaaaatggagtggccatttactgaggtggggaaagactgaaacaggtttttctgaggggagaggaggagagggtataaagggaaatcagaaattgatttgggggatgtcagtgagatatccaagtggcattgccaaggaggttgtgggagtttccagtttggagctgagataaactctcttggctggatatatcaatttagaaagtgttggtgcataaatgagacttcaaggtcatcaagggagagtgtgtagacagagcagagaaagagggctgagcaccaagcacttgcatttgaaaaagagtatcaggcaaggaggaggaaggtgagaatgtggggtgttgtggaagcccaggaaggcaattttctaggagatggggatgatccattgtctcaagtgtggctgattgatcatgtaagaagaggatggagaagtgccactgggattagcagcatggagttcattagtgatgttgacaagaaaggctctgatggaatgatgagggtaaaagcctgactggagtgggtttaaaagagagtgggggcactccgggctcagtggctcatgcctgtaaccctagcactttgggaggctgaggcggtccaatcacctaaggtcaggagttcaagaccagcctggccaacatgatgaaaccacttctctactaaaaatacaagaatgatccaggcgcgtaatggcaggtgcctataatcccagctactcgagaggctgaggcacgagaattgcttgaacctgggaggcggaggttgcagtgacctgagattgtgccactgcactccagcctgggtgacagagcaagactcggtctcaaaaaaaaaaaaaaaaaaagagagagagagagagaatgggggcaggtaagtggagacagagagtgtatatgactcaagatggtaggctgtgaagcagtgaagtatggggtggaagctgctgggcattgcagaggcctttgctgtctgttcccaccctgctggctctctaatttctccccagctaagatggacagttccccgagagctcagacatctggtcacagggccccatgtcaaacacatgctgagagtattttgctttctgttcttccccgaagtcagttcagcttgagagggcaggggagctaacaaccccattgcaacccacagctggggtgaccaccagactcacattgcctgggactgagagtcccttgttccaggaaacatctcagtcctgggcaactggggaaggttggtccaacttcccccagcaatggttcaactctgggcagtacctttgttcctgagaggctttgaggattcaagccagcatggcctgtgcaggtccttgatggctgcattgacttttccctctttccctctttccccactgcaacatggatgttgcagtgaaccttctccagaccattttgaagtgagtgaaaaagaaaaacataactaagtatcaatatgttgtttttttaccttatttttaaatgggaaataaaaattactaattgttggatttaaaaaaacctcacaataatgttaccttgaaacaagaggagcttctgcacctccacgaacgtccctcatctgtctgtgtacatattttatatacaggcagtgatgttgttcagagcgtgtgctccctgatttaaaaaagtcagcgccatattttaatatttcatatgttgttatagtttataaatggccagttttaatcgctgcagcattctttccacctcctcagctccttcttcctgggaccatctcctgaataagccacctatatacaagtccttgttgcaggggaacctaaacggagacaggagatatggatttattttccttctttattattattattatttttttagagacaaaaaatgctctgtcgttgagcttcaaactcctgggctcaagccatcctctggcctcagcctccctaaatactgggattataggcgttaatcaccatgcgtgcgtgcctgcctgcctgcctgcctgcctgccttccttccttccttccttccttccttccttccttccttccttccttccttccttccttctttgcttccttctttacttccttccttccctccctccctccctcccttccatctttcctctctcctttcttccctccctctctccctgttcagcacagatggaaccatccatttttttccctaaattttttcaatcgatggtttattgaatccaaggatgcctaacacacagttacgaaaggctgactgtacttcactgtatacttctgaaaaacaaggtcattcttgaacataaccacagtacaattattagaatcagaaaattaacactaatacaatagaattatttaacctatagactttttccagatttgccaattgttctaataatgtccttaacagcaaaagaaaatcttggatcatgtattgcattcagttgtcctgtctttagtttcctttgttctggaacggtctttgtttttatttcatcatgatttttgaatagatcacttattttgtagactatctatctcaattttggggttgcctgatgtctgttcgtgattgcatttggggttttgtacttatggcaggaacagcttgtgttttttaagatggcagataataacatgctgataggaatgaaccgatagaggggaaaagagagaattgctggatgatgctcttgaggggtgggagagcaggagggctgagctcagcctgaggactgaagcactgaatttggctggggatagatttttttttcttttgccagtggaatatatgatagattgtgagaagagaagagagttgagtgggtattcaagggaaagatcatccaggaatggaccaggggcacgagggcaatggggacaagaaagaggtgttggcagaatggaatgtggggcctggtagggccaaagagtcattagagttggggaactgtagaaaaggagtggggttggtcatcgaagagtgaggtgcataaagttgtagctattgataatgaaaacaaaatgaagattttgaccagagaaatgggtgattcaagcaggtggaagaaaatatcattggatggaagggagataaagtaacagaggggatttgaggatcattagatatggaaattactgagaatggtggctgaagtcatgccgaaaagcatggtagtgtgctagaagccagaatcctccagaaatggaaagagctcattctgggagcttcccaggaccctgctgagttctgagaccctcttttcattccactgagagtggtgtgaggaagagggagtgtgtctcgtttggagtagttggacctctggagaatgcttctttttctgtttgtttgttttaactctatctcatctgaaagataaatgctgtgacttttatgagtggtctaaaatgcaggactcacttttattgaagaaatgggaactaggcagcaagaagagaaccagcaactgcggagcttggatcacagagtgtggggtagttgttactgggatgtcatggagcattggggtgtttttccacctagggagagcatgcgggctcagtgaggcactggagacccatgttccttctatttttgcacttagccattcttggcatataataagaaagcctcgggtatctagagaaatccaaaggctctatactatgggccagctgcatttgccttctgatcaagccatcagtgctcagtgaaatgttgggtttttttgttcatatttgaattactctcttttctttatcatttacatgtaaagaatagatcattacattcttatccaggatctatgtcacagactttgttgcttcaaaaactgtagaagttggtacagcttgttacaaaaatcggccttctttgtcttcttaccccatccatatttttccctccttgtccatatttttaagccattaaaaaaaaatcctccaactgcacagaatagttttaacattgtgttcagcagattggcaaatctgttcaatgtagtgatatattaagtgtgagtttctactaggagaatgtctacaattttgcacctttgtagcatctgtctgtctcatttactttattaataaaactccagagggaaacttttggtgtattttttttcccatcagatggatctcaataagaccgaggaggtaatattgaaactggaaagcctccatcagcagcctcatatctgggattttctacttttactgccgagactacacacaagccatgatcatgtggaagatggcatggatgttgcagtgaaccttctccagaccattttgaagtgagtgaaaaagaaaaacataactaagtatcaatatgttgtttttttaccttatttttaaaatgagaaataaaaattactaattgttggatttaaaaaaacctcacaataatgttaccttgaaacaagaggagcttctgcacctccacgaacgtccctcatctgtctgtgtacatattttatatacaggcagtgatgttgttcagagcgtgtgctccctgatttaaaaaagtcagcgccatattttaatattttgtatgttgttatagtttataaatggccagttttaatggctgcagcatatatcattctggtaaagtactatatactgtaatttacttaataaatttggcattggatttttggttgtttctgagtttttcactattagagataggcttgaatataataatttcaactaatttcttaagaaattatgccatagttgcccagtatagcattcagaactgataagctcagttgcttcagttgtgtaattcagttagctggacgttggtctcctatgctggatttgacccccatgttacctggggtgacctttgggagcatcccttcccgtggtgggcttcttatgccttaatcagcatggccctcttttataaccaattgaattattttgtgtaaactcattgtatgaataatgggttttattatttttcattagcaaaggtttatattcttctctgttttttaactgttacttattctatctgccattggtgagagccacattacccttaagctacaacaaaaagggccctgtcctggggcctgtgctttggggaggtccccgttctggctttccctggactgtgcctctgctcatggctcagactgcccatggggtgaaggggatgtgtccacggagcccacacaccctgattccctctcaccctggagttccctaatttaatgaccagatcatggtcaagcctcttttctggcccctccttctgagggcaagtcttaacactggactgtggctcctgcagcccaagggtattctagggatggctgcagccattggcaggagtgtggggtgggaggcacgggtgctgttgggctttgtaggctggaggacctacctatgtgcactgaggccccttgaggtacagaccaagctgagggtggggagcacataggggaggagtggactgaaggttggggccagggacaggtgctccccaaactcccacattctggtgcgtaactctgaggatcacaaaattctaaatttgaatgtagctttccaagttgttatgaagatctatttgtcaatgtaggaaaatggaacgtattttgatagttagttagcttgatttataacttaaatatttgaacatatttgaaatgcctccctttgtattcttgcccgaagctctgactgtgttagcagtgaacaacgaaaataattggctattctgagagatgcaaaatttaaaatgagaagatattgatgacagttgttgaaccatatcagcttcagtataaattgtatttccatatttggcttcagtggcatgatatcaagaaaatctgcattcatagaagtatttgcaagtggtaccaggtttcagtgatatatcttataatcctgggatacgcttcaatacacaaagttgtcataaaagatttttcttgatgaaaatctacaaggaaataatctgtttggaagcacagcttatgattgtgttggtctcatgttgctaaaatgcagatatattccaacttctgttgagtgcattttctaatctacaaatttaagcatatttatttataaaataaaatattaatattttaaaaataaaattaatatgtatatgtagattctccctccccaaagctccttgttctttgaaacagtttaacagccactgattaacccttgacctattcagatccataggttaagacagggtggaggattgaggtacatggtattgccccccaaatattagactgattatctgaacttgaagcagccaggctgactgttcatttgcttttctaacatagcagccctttgcaccctggctggcctcatcagctgccctgcggcaggaagaatcaaggctgagtataaaataacacctatggcagagccaatgcaaacttgagttctgtgtcaaaggcagagtggaagatggcctaagttctcaagtgtttcaagagaagaccttacctcttacatttagttactagttcagggagttagggtcacattaaagccacaaagaatgctgacatgtaaatggtccagccacatcttgcaacagcactaggggcccagtccatgggatgtaagtaaacctagaattgatgctacttgttttgctaactacccactcatattgctttttgttttgttttggttctagttccttaatatccctagaagatttagattggcttccactcaaccaaactttttcccaggtttctgaacttgtactgaatgtgaccatttcgacactgacatttctgcagcaacatggagtagcagtcaccggtatgggtgccttgtagctattgctatatttcaaaacgtttaactacttaaattcattgacagttgacatagagctaaaatgatgttcaaaatgatttaattaaaatttcaaattcaaaaaagtatcaattgtttctgttaatacaagacaaaaatagaataaaaattttgaactcgaaactgaatttgactttctaccactgttgacattctgcagtcattgctaatataaatgatatttttaagttaaaaataactgattttaaagttctttgactttatttcatctaatattagacctatcactagctctgtgattttaatctttcctctctctaagctcctattgggaggaaatattttaaaaatggcaaagctagtaagaggaggcaggttgatgtggacttacagagtccctaactaaataagcagccctaccacaggggagggaatggaattatatagctcttttcttgatccaggatattattatttcctgaattaccaattgagtctgagctttttacttttaattcccttcttttctctatttttctatctttggctatttctctaagggaaatacagtgagagaacaacaaagttggaattcatccacccatttatctgttcatctgtccatccatccacccacacatccattcatccatccatccatctgcctacccattcacccactaaacaactcatcaacctctttatacatctatccatctattcgtccattaatccatccatctatccatctattcatccattaatccatccatccgtccatccatccatccatccatccactcactcatccattcatctgtccatccacctccccattcatctactcaccaacccaccaacccattcatctgttcatttatttattcattctctcattgaataaacaacgagcacttcctatgagccaaacacttccccagagagtgggaataaaaagctgaataagacatagttctttaatgagaatgcatggacacagggaggggaacaacatacaccaggtccagtcgtcgggtcgggggagaggggagggagagcattaggacaaatagctaatgcatgcgggtcttaaaacctagatgatgggttgataggtgcagcaaatcaccatggaacatgtatacctatgtaataaacctgcacattctgcacttgtatcccggaacttaaagttaaaaaaaaaaaaaggcatagttcttactttcaaggaagtcatgtttagtaaaggagagagatatgtcaataataaaaaacaaacaaacaaacaaacaaaaaacaaagaccacagagtaaggatctgacatctgcttcaggaaaaacttcaaggaggagttttgaagggtgagttggagtttatcaaagagatgagggagcatttccaggaagagagaagactgtgagatacttgggcttgctgagagctgtgaatgtttgacattcagtgtgtctgaggtacagtgggcagtagcagggggtggcatagaaaggagcccaggccaaaacacgagtggccatgggagcagtagaattagatctgcattatagaaagacactcctgggccggtgtgaggagtagattggaggcaggtagttctggggttcaggatcctgggagcaagtcttccatcagccactttctcctgaggtctcagtctcctgaactattattattattattattattagagatggagtctcgctcttttgcccaggcggcagtgcagcagtgagatcttggctcattgcaacctctgcctcctgggttcaagcaattctcctgcctcagccaaccaaatagctgggactacaggcgtgcatcaccacgcctggctaatttttgtatttttagtagagacatggtttcaccatgttggccaggctggtctcaaactcctgacctcaggtgatctgccctcctcggcctcccaaagtgctgggattacaggcgtgagccactgcgcccaaccctgaactattgtacaatgagattgttatacacagagatttctacaatcccattcagaattttgctgcttcatggagcaaactaacatgaaaccctctatggccccaaattccacctttccacctgttgcttctttcttcttgttgcttgtgactcagcacagtgagacccacatggaatttttttttttttttttttttttttagctttctgtaagagaaagctagctcattaacgtttaactccattttcaggttaggttagttccactgggaagtatttcttatgctgagaacaaaacccagaggtggggtgcgagatgaataaaacacctcatcgaaatcttcccagtgaccttaatttaacagactcatttagaagctcaagtttttgtacatcatccaaattacaacaacaaatttgccttacaattgaaaatgtaattaccgttaagaatgtaattaaaataaacaattttctattaactctccagcgagtcaaagctaaggaacactattacaaaacatactttgagaggtaactaaaaattgtcttcatgtctcttgtctccaagaaaaattcttttgcttgatgagccaattccaatgtgaagaggaagggatgagtggcctcatgtggctttaggctactggtccaattatgttatgcactaaaactgttaatctacacattctgaattctctgttgtttagcaacaaatttctgaatccaagttgtctttcactttttgagaaagattttatacttttataagtatgctacactgatgtcactattttttctctcctttctggaactctgtgagtaattctaataccttctgagaccagtagagattaatagttacagctcagctttggaagccagatcatttgggtttgaatcagaggcttaatctaacaagtgggactctaagaaaaaggggataattacagcacctacctcatagtgttgttggaggactaagtgagacctcccatggtgtattcttagtctaggtcctagtacctcttcaacatacaataaatgctggttttaatctcagacaccaatcttttttcctcccatgatgccatgtaaaggcaatcagactggaaacaaaaaatcttgtatttctgggattttccccatctttaacaccttcctgaagtccccgttgacttggtctgtctttgtgaatgtcatggattgtgcttttttttgtagacctcactgcaattataaggatcctatgagataatgcttgtgaaaatggcttattagtggctggcaggtgaaggggctcagtcaatgggtgttgaatcatcatgatctgaaacaatctaatttctaaatgaaggttcaagattcaaacacaccaagaaatttatgtgtttttatgtttgcagttgctgaggcatactccccagagattttgtcataccttgggggtcttcgatttatattttgaatgtgtcactactagatagtgccatgggttttttgggtagctcatgaattttatatgttgataacttgagttaggggaactttttcttatgacttcaaataattattgagaatacagttttaaagactccatagtattttatgctatggatatactataatttatcctttccctggatactagacacttaactggttttcaatattttatcagtatagaaccaataaaatattgtcgtaccttaatttttgctcagatatctgattaagcttcttgagaaagacttttagaagtgaaattattgggttcaatgacttgaattttataaagctcttgaaatatgttttaaaattatcttctggaaatgttgcaaccatttgtgccagggagcatgggacacttcaccattctctctatagcagcaagtgtttattctgtttgctttttctatctgatgccccagtggtgtttggtcttcatttgctcttcctttagaggtgaaaaaaggtattttttttctggattacattaaacatatcaaaatattcaaacaactgctggtgtaaatcttttgttattccaacagagccagtttaccacctgtccatgcagaatatagtgtgggatccacagaaagtccagtatgatctcaaatcccagtttggctttgatgatcttcacacggaacagatcctgaactcttcagctgaactgaaggaggtacacatgcttgactgcttctcacaccgctgggcctttcctggagactggatctagagcatgctgctggggcagggtgagcgggtgccacgggagaggcagccagacaggagagttcggtcaaaacccgagctccttacgcagaagagacccctactgtctccagcttttctagaagtgtctctttcttcttaccatgtagttttatcccagaatggaaaggcagcttagaaataatatgacacttgattgctctgggaactagcagtgggagaggccaggtcaagtgagggtgtgagattctgaagacagcgctagtggggtccaggtaggaagatggtgcaccagctgtagtgagtggggatacaagtgggtgaatttccaggtaaagagatagttttcattagaagagtaggagctgtacgttatggatgcctgctgggttcaccaaagttgagcctcttccctaactaggtgaaataagggagttggactggatgatcgatccccaagacccagttcactgttggtattgctgaggttctgggagatatcttttagttacagagtcccttttgtcactccagcccatttgtaggcacttctgctttgcatggtgcaggtccaagaactatgcgggacctggagctttggtccatagactccacctccagggttagagcatttctggtgcagctcctaggtcagtgttgagttaggaatgtttggagaggacccactctcttccattaggatctcagtccatgctggttatgtagattttgctcacttttttgtgagttccccacaacctggtcttcccagatagcacttttcacatttcagtgcagctagtttgtgttcagactgttgctttcagtatttagactctggatctgtgctctcagtctcaggggttagatggttgggttgcagccagcagaccctcatgctggcttggtgtttgaaaacccagttctaccaggtaggtttaggcttcaccaaagtatactaaattttgtgcttcttgtatccctggcacaattttattaatcatctcacaattttatgaactatctacctaccacaggacttgaaattgtgacccttgggttttctcatggatgctgatgtagatggaatatgaaaccccagttggctgacttttattctagttttctccatctttataaccccgttttctcattatattatagtttgagtgaactatgtaaaacttttaccttagaatgttcaatatattgagattagaattaaaaggaaagtgatcagaaaataccactgtgtatatcaacagagctccatggaaattgtacatcatgtgtgtgagctttctattgctgctgtagcaagttacccccaacatagtgccttaaggcaactgacattttcttttatcatagtgttctggaggtcagatgcctgaaatggtctcactgggctagaatcaaggtgtctgcagggctgcaatccttcttgaggtcaaggggacatactgttgtgggggaggaaaaattctttttttctctattattccatcttcaatggctggggctcatgaattaacctgataaaagacagataaagaagaggaaaaccagttattgtgtaggtatgtatgggagttcacaaagagaaatgtgtagatcttccctgatgaccattctgtttttcactttcagtatagtattcaataaattacatgagataataaatactttattataaaataagctttgtgttagattatttttccaattgtaggctaatgtatgtgttctgagcacagttcaggtaggctaggttaagtttggttatgttttgaggttgggtgtactaaatgtattcttggcttatgatattttcaagtcatgatgggttgatgaggatgtaacctcattgtagatcaaggatcacctgtattttaaggaagcagccagattattaaggcttatatgccatccaaggctatctatacaaaggaaagggggcttggggtttctgagtagcaaggcaagttatgggaaggtgaggggaggaaatatatggtgaatgagttatcctgttttgcagagaaatctcccaggtgatcagagttatttggagaagcagctctctttttggtaggagacatctttacagatgaaaattatcttaataatgtaaattttctttataaatctaaatttcctttaccaaaaggaaatttatactctatttttaaacagttagggaacggtaagaagtttttcctgcctctgctggttttcagtttgtctttagctcaaaataatccatatgccaaagaaacatactttggggtggcgtattctgttttcttgctttttccagcttccagtggccatccacattccttgggtctgagcctctttctcaatcatcaaagccagcaatggcaggtctagttcttctcatatcccatcacttgggcactgacatttttgcctcctttctccaataaaaacccttgtggttacactgggctcaccaggttacccaggataatcgcccatctcaaagccaggtgataagtagccttaatttcatctgcagccttaaatctcacttgccatacaacataacatattcatgggctcttgggattgggacatggacatcttgggggaacattgcctgcttcccacccttcgtaagtgtaattgcctggtgagctcttcctgcccactgcacagacaaaaccaattcattgagactgcagtattgcagtagagaaagggtttaattaatgcagagctagccaagggaaaaaactggagttattactcaaatcagcctccttgagaactcagagggtagggttttttttttttttttttttttggataatttggtgggcaggggactaggaaatgagtttcgccgattggttggggatgaaatcacaaggatgtggaaaaatgcaaaagtctgaaaaacgtctcaagagaccaatcttgggtttgacaatagtgatgttatctataggagcaattgaggaagtcacatatcttgtgatctttggccccatgactcctgagcagcaagggattatagaaggcaagctagggaccagtggctgattatcatttagctacacctacattttagcagcattcaagccactctcataatcttaatcttgtggccttttattagtcttacaagggcaggttctgtacctgagaaatgaggggattcatcttagggagggactactatcaaccttgctaaaaagttaaactacaaactaaattcctcccatggttagcttggtatatgcccaggagtgagcaaggacagccagcctctgaggctagaagcaaggtggagtcagccatgctagacttctctcactctcataatctgcaaaggtggtttcacagggccctttccatctgcatcagcctgtgagcctaggccctccctggggtctgtctgactcctgaccctgtcactctctgggcctgctgggggcctcagcacatgctgcccctgcaagagaatagtcctcctctttccctgcctctgcctcctgaattggaaaatgatttatctaacctcacatcctctgtggatctcctgtgacctcacttcagcctctgcctctacttcttcaaccttctataatagggcatgtcccagggagcctgatggctgcatatctgcctctcataggctgtgagcatctgagtggggacttggccttatctatctaacatgatacatggtattgttgattatttttaattaagggaaaaaaatagaacaaaacatcagggaccctgtgctttgacagtcacaggttaatattttaaatcctgatccaaaaggaacctaaaagtgaacacatgggactaaaattaagctttctgactattgtcattgtttagtcaattcaggctgttataacaaaagaccacagacttgtaaacaacagaaatttatcttggtgtgtcctcacgtggtagaaggggtaagggaactccctgggtctcttttatcagggtgctaatcccattcacaagtgttcaccctcatgatctgaccagctccccagggccccatctccttataccatcaccttgggggctaggatttcaaaatacgaattttggcggggaggccacaagcatttagaccatggcagtcaccaacagaatctcttaaagatggcattataattgttgtaaaatgatgtaataggggaatgtgcttcattatatcataaacataagtatttacaaagcagtgttacaggaactctgttgaagttctttttttttttttttctttaagacagagtctcactctgttgcccaggctggagtgcagtggcacgatctccgctcactgcaagctccgcctcctgggttcacgccattctcctgcctcagcctcctgagtagctgggactacaggcgcccaccaccacgcctggctaatcttttgtatttttagtagagacggggtttcaccatgttagccaggatggtctctatctcctgacctcgtgatccacccgcctcggcctcccaaagtgctgggattacaggcgtgagccaccgtgcccagccactgtgttgaagttcatgtataaaataaaggagatttggttcaaaaacattaaacagtttctgacccaggacttcaatttgaatctttccaattttatccacttttgatagtcagaaaagaaaatgttcttggcaaaacaactttgttagtccgaagtatgaattaaactgggctgacccatgttcacttttggcctaagaatgaaaagaaacaagatttgatgtcatctccatgtccttggcctggagaaacagctgttcctattgtttgtggatgaaactgaaaaatataactttttttttttaactaccaagtcttccctcaaggtaaatcacatagatatcatcacttacttcttcaatcaagcaaatgtaagaacttttactgtggcaagatcgtggtgttatttttagaagaggaaggttctaggaaaggagctttatgtctaaatattttttcatattgttgtcagattcccacagacacttccttggagaagatggtgtgttcagtcttgtctagcacatcagaggatgaagctgagaaatggggccacgttggaggctgccaccctaagtggtcagaagccaaaaactatcttgtccatgcagtcagctggctgcgagtctaccaacaggtgctgtcccctctctctatgttctgttcaaaggtgtgccagtttgagtgtccaaatccattctcctcccctgccctgccatgtttactgttggattttatgtccctccaaggaaagggccttaggagccccacatcctggccattgagtgcaccttgtcccatgtgcatcaactggctccagctccataggcctaggccctcaacactcatcaccaaacagtctatcctaggcttgcacacacaccttggcaactcagaagttcctagacccatgctctgttattggtgcatgagattgccctggagtactatgaccagctctttggacatttgcatgctagcattgggcatccctctagcactttaagctctgaactggccttgtctcttcactctggttttgaccagaagctctgtgcacaaacagtgactgtgatttcagtgaccataatttaacaacacgaagggaggctctagtctgtctttatagggatgttggtgtggggcagagggcctgagtgattagattgctcctggcctcagaagctcatggagccctggctgtttcacagctttgcgcttcttggggaggttttggagactgtgaggcagagctcccctggcagtcacttcccatttgttttatcaggctttgccgtctctgtctcatgtttttccttaaagaacacacctctttaactttgttctccgctaatatgtgtcatgtataaaggccaaaatctcaaatggtagataaaacatccttaaaaatatataggtgttgtcgtctgcttcgtggcactaaagtcatccggcactaaaataatcaagggacagtgctgaaatgaccagcatccaatggtctagtggacacacttgctttgtgcattatctgggtaacataactcatggttaattaaggcatagttagcacacatacatgtacatcgtgcacctctccatgccatcaggcttgggcaagaatgatctatttttgtgtaatgttgatgacaaaccacagtgctaattgacttcagtatcatcctcaccatgtccgtgtcgtaaaatgacacttagtaaccatgtattaactttggtatatatttaaaaatatgcaaatatatttatgctatcctaaatatgttcgtttaggttttaaattgtatttcatttgtttagaggtgtatgttattcccttctctctttttctcttttgggggaaaaaagagaaataaggcagagattataaagttgtgtgcatccattgttgcaacatgaaatctttaatttctgagtagaaattaaatcatactgcaattgctaacagacattttaatttaccaaaaaataaagattggctgtctgtcatctagagtggtatgttaatatttcttaactaaatactgttctttccaatttgctattattaatgctagtattttggtttccgaatttgtaggtgtttgttcagtggcaacagggtagcctgcttcagaagacactcacaggcatgggccatagtctggaggctctcaggaatcagtttgaagaagagagcaagccctggaaggtggtggaagctctgcacactgcactgctcctgctgaatgacagcttgtcagcagatggcccaaaagataatcatacatttccaaagatgtaagtcgcatttccctgtttgattattgattaggtagatgacacagaatgttaaagagtgcgtgatgatactgttagaaacacattctgtaaaactacagctaaataatgaatttcttgttagcaaatgggaaatcagaggctttcattgtggaccatcaccagggtagaagtcttggcagcactctggatgcctattcagaggctgcaatcgaccgaatacgggagcaatgtttgagaaggtgtcagtttcctagattttagattttatgtctttggcatttgtttaaaaatgaataaattcatttcggaggcatttttatgtacagaactaccttacatgagtagctcttttcctagaatcttcctcttcaaaaaatatgtttttatatttacttaaagattttgtatagttgaagtgtttacataaggtccagaaatattgtagaagtaggaaatggtggaacttgtttcttcctttttaagataaccacaattgattcaccaaaatagccgactagatctttttccttagtaggtgtggcagtttgtagtaacttgaatcttattatccttctgaagttaaggctgtctttggaaaagaagaatatgatttctcaatattatctcaaaaatgtgcatttcaaaccaggtcacacaaattcttgctctctgtgtaccatgaaggagagttgtgatgacagaattggataggaccatattgtgttcttatgattacttaagaaatagcaattctaaacacttccagttctttcacattttctggaacttttagcaaacaggatcttgcttttgaaggtcctatttcctaacttttacttaagagatgttctggggcctgaggtgcttgcgctaaaggcagaaatacagttccctatccgggccataaaagctacaggaggatggatgcagggagccagcaaggatgccttgaagtagtgttctaggcaaagggcagggacaaaacatctgtcataaatgaacaaatgcagggacattgcactggggatattgaaaacctccctgctggtctgtcacttaatgcacattaatagaaacaccacattaagtcaccgtaattatcctacaaatctcgaatgccccctggcactttagcctaggattttgcctgctctgtgccaggccaggggattgaagccccaggaagctgtacttggctcttagtcctacagagatggggggaagctgaagactataccacactctaggtacaaagctaggatagcccacattcttctgcccccatataaaatttccacacattctcagtgccaggaagatgaggcccaaacactggctttgctgtccatctgctgtttttttttctttgttttgttttgttttgctttgagacagtcttgctctgttgcccaggctgaagtgcaatggcgcgatcttggctccccgcaacctccacctctcagactcaagcgattctcctgcttcagcctcctgagtagctgggattacaggctcacaccactactgcccagctaatttttgcatttttagtagagacagggtttcaccgtattggccaggctggtcttgaactcctggcatcaagtgatctgccctcctcggcctcccaaagtgccggaattccaggcgtgagccaccgcagctggccaccttcagccttatttaaatctttctgagattcacatgcacccttagcagaaaattgtatatcttttatcattagctttggtccaagaaaccccatccctttttcactaccttgtcttcatagccaattgttcatatctttttctcttcctaagctgcaaagttcacccaaaataaatggaaatcacaccagactctcagttttctactgagtttttcgtgtcattacagactgccttttctcctccaggttctttctggttcctgcccacgtccctgcagtacgggtggctgaggtgtgggagctcttcacccaggctctagcagatagcgtggattttggcaaggcgaggactcacagaggtgcctctgcgccttccagcaaggactcacccttcaatgtcgcacgttgttgtgaatgtgaagtgtctgttcacagatgtggggggaatagtccctagggtctggccatgtggtatccttgcttgtcagagtttaaagagacttgacagtaagatccaggttccaagccacacagcatttcttttttccttggggaaaataaaataatctctttctcactttctagctctttccaagtgccactctgcttccttctcagtgtaatccaaagagtcagaacaatgactgacctaagcccagttcattctgcagatggccaattccaaaagccatgtgtccagcttcactctagcatgaggtgtcaggagtctggtcagcagccagaaagcccaagcatgtggctctgatggagcaattgctccgccttgtagggtgatgacgtggggatgggtaccagttcctgctggtgtcttgtaggagaattatcattgggaccttgctcactctctctataccctttacggtgcttgggtccatcagctctccagctagagaatagcagcaactatttatcaagcctgtgttcaaccccaaactatcaagatgccatgaagagactgaccactatggcacagaagtcgaaatggacgccaggcactcaaagcagtgggatggctccagccagtggaacattttgcttgggcttcaagtagctacatctctttctgcttttctccttctgtagcttgcttcgtttatcacaggtgaggattccatgcagttgctcaaagacacagaaagcctggactcacctgctctgggcagttctgctgcccacagtgtggctatgccttgcttctccctctcccgtatttattcccaatttcaggttcttcacattatcaaactcattttctttccagcttctcttctcagttgtttcttccatgtctggagcccgttagtctgacattctagggactatttgtattgagctgcctgggtggtcgttcttcctttgaccttggagaatcctacaggcattgccaattggctcaagttgggaccactgcgatgggtcctgtataccatcacacaccatctctatattttgaaacttttctcaaaatatttttctatatctcattaactataggcttcaaggcaaatgtttttagaccccatgtgaaactttatcctaaccctcacttcttttacacacacctaggaatatactttcccattttggggtaaagagaatgtttaatccatattcagtattgaaagaatctcccaatcaggtgactcaatgcaatttgtcaagaacctggttgtgtgatgaagtgtgactttcagtctagtgaacacacttctcaaagcagtggaatattttcctttgaacggaatttttatttccctaattggcacttcgaactacttttcattttatttcatttatttatttttgccctcagattacagcatctgtggaaattgcaaagcttgctgcaaaacctgccccagtggccggcactgaagagatttcttcagcttgatggagctctcagaaatgcgatagctcagaatttacattttgtccaaggtaagctagctttggtgttatttgtccctgactcactaagagtaaatgtgaaatttattggaaaatggacttgaaactgcctgacacattgtaaagttgggagataactttgctggtgtcatatgcatatttatgctttactctgatgccttctaggggatttaaaatacagcacaccaaggctaaataaacaataagggcacagtgaagagcgcatccttctgttttccttaagcccatgctgtggcctatgacaagcagtgtcctaaggctgggttgactttcacattcacggcagcatctgtggttttcaggctggaaagggaccagagtgcgttgtgaataagcgtatcttttgtattctgttccttctactgcctcctcccaccaatgcttcttggtgtccggtagggagagtgtgttccccctgggtttgcagaatgcccttctttgaactttcttgactatggtgagcattattctttcttccctcttctgaggaagttgggtttggacttttgcccagatgggctgcagccttttcattttctcagggaggagagggaaaaagtgaggggggatgttactttagaagtaaaaactcattctcactagtctttggaaaggacaaaatgatattacaatgactcctgttttcctttctaaggaagagaagaaaatgtataataataggtcaagtttttaaaaaatccatgttttcaggatccagtttattgattcatggccatgtataaaagtcaagcttacttaccttaggtgaataataatcaatttgtctactttgcagaagtcctcatttgcctggagacatcagctaatgattttaaatggtttgaacttaaccaattgaaactggaaaaggatgtgttcttttgggagctgaaacaggtaaagcacaacaaataattataaataagcatttttaataaaacattcaagaagctcatgcaatattcagttttgctccttttgtgaattgtgctagctaaaaaagggaacaatatgcaggtttttcaaaactttatgttgtgtttaaaatgtttatcattgcttattatatttgcagttcttgagcccatgaagagggtatctaagcctctttaaatgttactccttcccactcttattaatcttttagatgttggcgaagaatgctgtctgcccgaatggtcgtttctctgagaaggaggtctttttgccgcctggaaactccagcatatggggtggtctccagggactgttgtgctattgtaactcctctgagacgagtgttttaaacaagctacttggttcagtagaggatgctgtaagtattctaccatcttagctcttctaagggcacaaatttaagattaaattcaccaaagatgctaatatttaacctggagtttcgatgaggaaagttttgccgtaagcccacacacttaaaggaagctggctctctgaactccagctgcccttcaatgctggcctttctgtctgactgaaaggttgtatgccacccgcctggccaaaacctacttgaaattcctcaaactttcaaaacataccacttcttcttttctggcttcctggatccttgatctgcttcattcttggctgcacatgctaagaaaagcagaggagtctctggtgattagtcaatcccagcaaaactgtggctttgagtggttacaagctttaaaagtcatattcctctcatgtaactgcccaggacaatgggctacccctgttcagcgctcaagtgggactgcagaatgttgaacgatttgtttggaaagattattttgtcaagttccagccctattcttcttactgagaattaaaattacaatatttatatttttagagttcatttttctctctcagtattaccttttttttttatatccttatataccatggaaataaaaccagtgaaataatgaaactagtgaaatataaatggtgtctcagcaaaatgaaaattgggatagtaattgaatagtgtgcataattcaatcaccgatttcttagcatctactctgtgcatgacagtatgctgaagggagtacaaacatgaagaagacactatcttggtagagaagggcaaacaacagtgagagccttggagctcagcatctaggagtcttcccaaataagtcaatgagccttagatgaggtgtaagatttggaagcaaagagaagtcaggagaggatgctaagcaggcagaaaattatatgtgaagggctgggcatagtagctcatgcctgtagtcccagcactttgggaggtctaggtgggcagatcgtttgagcccaggagtttaagaccaacctgggcaacatagctaaaccccatctctacaaaaatgaaaacaaaaattagccagatgtggtggcacatgcctgtaataccagctactcaggaggctgaggtgggagaattgcttgagcccagcaggtcaaggctgcagtgagccatgatcacaccattgcactccagcctgggtgacaatgtgagaccctattaaaaaaataaagaaaagaaaataaataagaaaagtgtatgtgaatgcatgcaggcacaaaaaacattacctgtttgcaaatacctttcttgctactagatgtcagctctttcctggcagaaatcctatctcaaatttatttttatctgtaaagtctaacttgtagtctcatacgaagcagggaactatgtatttataggttacatatacttgaggtagccttttggatgatgcctacgatacgtatcactaacaaatcaccccaaagctcagtgacctaaaacaaaacacattattttctcgctcttctgactctgggttgaccagtctccgtggggtggttcttctgatggtcttactgggcatcattcatgtagttgcagtcagatggccgtgagggctggagtctggttagctaggatactgagacgagggcctctcatcctcctctcagactcaagatgtctcttctccaggtaacctctccatatggcctttcagcagggtagccagacttctgacatggctatccagggatcccacacacaagcaaaaacaggcaaggagggagagtaggagctgccagtcctcagagaaggtagaactagaactggcacaattcacttcagctgcattctatgggtttacgtgagccagatctcagcctagaggaattgtggaaggtggtactgagagtgagactctcagggggtctggttcacaggctacttgttgcaactagctaacacagatagctatgacactgagtcccatcctactttattattggattaagttttatttttggacttattaacctgaacatgagtaaagattcaagtctagaactataacttagataattaccatgccatagggcacgatctttgatgtacagtttgagtggaccccttgtttagtgatacagggtcaaggctgcgtctcaaatacccacatctgaattgctttatttattataagcaatatcttcttttcttgttaaggatcgtattttgcaagaggtcattacttggcacaaaaatatgtcagttttaatacctgaagaatatttggactggcaggaacttgagatgcagctgtcagaagcaagcctttcctgtactcggctcttcctgctgctgggagctgatccctctcctgagaatgatgtcttttctagtgactgtaagcaccagcttgtctccacagtgtaagtacatgtttggtgggaaacttataaacaattgggacatcagaatgatttcaactgccccttctacacaaatgatagatcaatatggtagattatattttgaatagaaagaggttcaatttattttaaaaatattaacctactggtactgttggaaagcatctaataactgtaaaatatgaaagagttcccttaatgtttaaccactgacttaatctttcattagaaattgaggatccctggtaagtccaaggtatgcatgtgatggaagttcttgttaattactcagaaattgtgcactaagtacaaatgggaagcttctcttgggagctgtaactctacagaaaattcgccttgattttattttatgactctgtgaattatatgtgtgatcaatttccattttccttgactgctaggatgttcttcgtcaaatatgtcaaatagggaatatatattttcttaatatttaagttcacttcctgttatggcctttaattttcctctttttttgtccttcttgatttattgtcttatattttatgtattctcataaattgcttttccttatttttcaaatcgaggtagaggagtttgtaaacaaacttaaaaaattagtagaactatttgaaagattctatttccttacataagtggactgccatgcatttgcatatatttgtttttagaaaaatttataatgatctgtcatctgcaagatcatttttaaattttaattttctctggattctttttgattgcaggatatttcatacacttgaaaaaacacaatttttcctggaacaagcatattattggaaagccttcaaaaagtttatcaggaagacttgcgaagtggcccaatatgtaaatatgcaagagagtttccagaacagactattgggtaagtcagtagcctaaactacaggaatgggggatgctttccccttttagtgaggtgacataatttcctgagagtccatcctatttaacaaagcggggcttaaaatgggtggctctccaagcacaatttggcattgtgattacttcatataattttttctcatcaattatgacaagacttaccagaagtcctggtttgactgagctacattgttcctgcaaaatttataatagtgactgcttttactctcaagactgtcctggtttgggtgataaatacttctatatgcagactagtcatgatcctactcacaagagtccagattttctgttgtggcccttctcactttacttagcattaagattgatgctcacactggggacaactccccatgaacctatagaagaaaacacaaactgtttttctctatacacacactcaacacttccaacactgctgtgaccatatgtgtggatttgttccacaacaagcaattctccacttctccattgacactaactgggtgtcctacaattcgattcaattctcgcactgtctgcctggaattagcatcagatcctgcaggttaagggctcagtcccacaagattgcccctacttcagacgccaaccccaagtccaggcttcccttctcacttctgatcaattgggtataaatcaggattcccatgaacccctcgttgtgttcagtaatttgctggtacaagtcacagaatgcagaaaaacagcttacttcctaggttactggtttattaagcagatataatttaggaacagtagatggaagaaatgcatagggtgaggtatgtgggggcatggagcttctatgccctctccaggcctatcaccctcccagcacctccatgtcctcatcaacctatgagcactctgaacactgtccttttgggtttttatggaagtttccttatgtaggcatgatatattaaatcactggacattagtgattgactcaacttccatccctctctcccctacctagaggttagaaggcaggtaagggaatgggaggagggagaacctgaaagttccaaccttctaattacagggttggttcccctgacaatcagcccccattctggggctatccagcgcctctagtcaccagtcattcattagcctacaaaaagacaccacttcctacattccaagggtcttagcagctatgtgcctgtcaggaaacaatggcctagaccaaatatatatgtatgtttttattatgttaatggctcacctctttccttatcagcttcataaaaccaaaaattccctaaaatataaatattacaaactcataactgtatgattcacagggagtcctcctgttccccagagatctactttttggaaagatgccagcatgtaaaacttgcacttctgacctctgcttttttactctagagctggttgtctatttccatctctccttgggaattatcttctgccctggttttccagcatgccatgacactgctccatcacagtggggttatcagcttctccttagaaagcctgcatcttggacgtcagggacttggacaggaaatgggagtttctcattccttttctgtggctattacgaccttgccttttcttatttcatgctgttttttaaactgctacttttagaggctgccagagatactccctctgtagctctcagtatcaaatccacatatggtaagatgggcctttgcattttctacagattacactataaaactcttctgtatagcagcagtattgggttgatggtaacttctccaatgagttggccatgttcttctgggttgagtactcatcctacactttaactttctcctatactacctgtcctcattatcacttattattgcccacttttgactcttttcagaaacaggctacagagagtgatatgcaatagtggcaacaggcttgtggttcagaagtctcaatgatactgataattgcaaatatttattgtgctttctatgattatcttgtttaatcctcattcaacctgtgagataggtaccattatgatttcattttcagatgagaaaattgaggctcagaaagattttattcctagcataggtctcaaaagtattaagcatcaaagtcaagaatgcaaatccaggaagtctcactctggatcctgtaagcttaaccactctactttctttggacagacccttgctgggggctgatctctgtgaaaaggcttgcactgtcacagaaatataactagtcttattaagaaacggaatttaaaaaaaatatttttactaaatatgtatattattttattaatttattttttatctttattattttctttcttctagtaaatttagtgtgattgttgttctttttcttgttcttgactttcagattttcttattttctaataggtacttttaagacaataaattttcctctatgccgagctctaggtatatttcacacattttaatatgtcattcaactgccttctggcatgtaagagaagtcagttggtaatcttataaaagctccattgtatgttatgagtcatttttcttttgctgcttttaagattctcactttgtctttgactttcaatagtttcattatgaggtggcttcgtatgggtctctttgggtttatgctacttgaagttttttaacttcttgcatttgtatatccatttagttttcaaatgtggggtgttttcagccgttaattctttaaatacactctctgcccctttctctttttctcgtcttctgcatgtgtacattggttggcttgatggtgtctcataagttccttgggctgtgttcatttttttttctttgctcctctgatttgattgtttcacatggcccatctttaagtttgtgggttctttcttttgcctgaatttctaaattcagttattctattttttagctccagaatttctgtcgggttctttgtaaatacagccatgcatcacttaataatgtggatgcgttctgagaaatgcattgttaggcaatttttccattgttcaaacatcatagagtatatttacacaaacctagatggtatagcttactacatacctggagtatacggttagcctattgttcctaggccacaaacatatacaggttattctactgaatactgtaggcaattgtaacatgatagtaagtatttgtgtatttaagcctatataacagaaaggtaaggtaaaaatatacgattataatcttacgggaccaagcatcattatgtggtatatgactgtaatctctctctctttgctaatattccactttgtttataaaccattttctagatttagttttgtgtttttcactgtgttttctttgagttcattggccatatttaaggtagttgttttaatttatttatcaagtaagtcagaggcctgcatttctttagcggacaatctctggagatttatctggttcctttgaatcattcatgttactctgttttattttggtatgtcttgatacgttctcttgagatttggacacttgaaaaaaatttccacttcccccagcttttgtagcatggctttgtgcaggggaagaccttcattgcccaaaatgttttaaaggctcagggtcttttaaatcttttctgaagatgtgtattccctaagcctaagtgtgtgtttttattccacttccctgcatacatactatctgctttaaaatgtattattcagtctcctggttcatctcaaaagccttggatgtttattgtattcctatgtccataattgattactcctagccgcctgcaggtctgcagactccctgcagctctaacatgccacagtgactgactgctgctttcagtggcctccaacctggcatccaaactatgccacttttctcatctgtgctctacatcaggcaagacagaaaccagtcacttcggcagcccctaggcaagccaaatattgccagcaagttctattttttcccttgtatactgagggaggaacttgaaattgatacacatcttcctgacagtggcatattgtgccatgaaggggatgaagagtgaatgagaaaaatgtcacaaaatttcacaatgagtgtgacattttcttgcattattagggatttacctggttgttgcatcttcttaactgatttctagtgcaatggtgcaatctcacctcactgcaacctttgcttccaggctcaagtgattctcctgactttgcctcccaagtagctgggactacaggtgaatgccacagcacctggctaatttgtatttcttgcacaagtggggtttcgccatgttgcccaggctggtcccaaactcctcagctcaagtgatccacctgcctcagcttcccagagtgctgggattacaggcatgagctacaacacctggaatgtttcttcatatttatccatcttgaggacttaagatgtgtggacttatatatttattgtctttgaacaattccatattactatttctttaaatatttcttttacctcaatttctttttttttcttattaggactgtacttacgtgtgtgtgtgtctgtgtgtgtgttcgtgtgtgtgtcccaaatgtttcttcttttttctatattgttcctcctgttttctttagtctctatgcctcagtctgggtggtttttctctgatttattttctagttaagaaattctttctgcagaatgtgtttaattaagcttactcctttaattcttaatttcagttatatgttctagaattttcattttattttataggttttactaaatattttctgcctgataacttcaataattttattttctgggtgtcagtatctattgtatgcttttcctatttttttccccaattcctattgtttttttatacaactttttttcttttaagaggtagagtctcactctattgcccagggtggaatgcagtggtacaaccatagctcactgtagcctcgaattatgaggctcaagtgatccttttgtctcagtctcccaagtagctatgacaacaggcttataccaccatttgcagctaatttttttattttatttttttgttaagatagggtcttgctatattgcccaggctaatcttgaactcctgggcttaagagattctcctgccttggacacccaaagcactctacataaatctttttattaaatgcatttcagacattatatgtagagataatgcgacactctgcatgatttttttttcctccagaggtgctttagttttgtttctggcaggcagtgagagtggaggcatatcgctttaattcagtcaggaattaaactatttttgagcatgctatgaaactttgtgagagctcaattgtttcttgtcttcttttactactggggtgtagccttctgggggtatcaagctaaatttgtggtgtttactaaaggcaatttttcctcagctgtctgtgaatttcagtttctttcctagtcttgtgaggcttttgaaagttcttattttcgtagcctctcttccctcatttttgttttggaaacaacagttgcccacagtggaaaagtagcttcaaatgttggacttcatctctcctgtcttccctattctgtaatgttggcacacaaattcccagtgcctcagtagctctctgatgccttaaaaatcattaaaaatattgttctcacttttctggatgtttgtagtggaagggttggactacaacaatctagtttgctacatacagaaatttttttccaatttagaattcaaagctgtcatgtcactaacctctgagtgagaaaggctgtgcctgtgactcagtagttcagccttgagaagctttctcagcatgagtagtgttgtggtaaagagcttgaatgctgacgtcagactaattagtttctaatcttggctttgcaacagattagccatgtgatttggtggcaaattgcttcagtttccttatctataaataagtttcataatattaaaggaattaatacttaagacagtatgtgatgatcccatcacccaggtagtgaacatagtatccaatagttagtttttcaacccttgcccacccctctttccctaatctttagctcccaatttctattgttgccacttttatatttatatgtacaccatatttagttcccacttataaatgggaacatgtggtatttgattttctgttcctgaattaattttctgagaatactggcccccagctacatccatgttactgcaaaggacatgatttcattcttttttatggctgtgtagtgtttcatgggagtatatgtaccaccttttctttatccaatcaactcttgatggacatctagctggattccatgactttgctattgtgaatagtactgtgatgaacatatgtgtgcatgtgtctttatggtacaatgatatacattcctttgggtatatacacaataatgggactgctgggtcaaatggtaattctgttttcagttctttaagaaattgccacactgttttccacgatgttgatctaatttactttccctctaacagtgtgtaagtgttcccgtttctccacaacctcaccagcatctgttactttttgactttttaatgatagccattctgactgcagtgagatggtatctcagtggttttgatttgtatttctctaatgcagtggagtattttttcatatacttattggccatgtgcatgtcttcttctaaaaagtgtctgttcatgtcttttgcctactttttaatggggttgttttttgcttgttggttttttaaattccttatagattctggatattagacctttgttggatgcatagtttgcaaatattttctcctgttctgtagggtgtctgtttactctcttgatagtttcttttgctgtgcagaagctctttagtttacttgggtcctatttgtcgattttttgttgttgttgcaataactctgatatcttcatcttgaaatcttttcctgttcccatgtgcagaatgatattgcctaggttatcttccaggatattgatagttttaggtttaacatttaaatctttaatccatcttgagttgatttttttatatgagatgagaaagggatccagcttcaatcttctgcacatggctagccagttattccagcaccttttattgattaaggaatcctatccctattgctagtttttgtcaactttgtcaaagatcgatggttttaggtgtgtggccttacttctgggctctgggctgtctattctgttccgttggtatatgtgttttattttttatttttattattttaccagtaccatgttgttttggtttctgtagccatgtagtatagtttggaggtgggtaatgtaatccctacagcattgctcttttgcttacgattgccttggctattcgggcacttttttgattccatatgaattttaaaatagttttttcaaattctgtaaagaatgtcatcggtagtttgttaagaataacattgaatctgtgaattgctttgggaaatcttaataatattgattcttcttatccatgaacatgggatgtttttccatttgtttgtatcacctgtgatttctttgagcagtgttttttaattctcattgaggagatctttcgccttcctggttagctgtattcctaggtattttattctttttgtggctattgtgaatgtgattctgttcttgatttggctttcatcttggatattgttggtttgtacattgattttctattctgaaactttgctgaagttgcttatcagatctaggggctctggggcagactatggggttttctaggtataggattgtatcatcttgcaaacaaggataaaactatccctgtttggagacttcctctcttcctgtttggctgccttttatttctttctcttgcctgattgctctggataggactttcagtattatggtgaataggagtggtgagagtggtcatccttgtcctgttacagttctaaagggaaattcttctagctctttcccacttagtatgattttggctgtgtgtttttcatcgatgggctgttattactttgaggtatgttccttcattgcctagtttgttaagggtttttaaaatgaagggatgttgaattttatcaatagccttttctgcatctattgagatgatcatgtggtttttgtttttagttctgtttatgtgataaatcacatttactgatttgtatatgttggaccaaactttcaaccctgggataaagcctacttgattgtagtggattagctttctgatgtgttgctgatttggtttgatagtatgttgttgaggatttttgcatctatgttcatcaagcatactggcctgaaatttttgttgttgttgttttgtgtctctgccagggtttggtatcaggatgatgctaggctcatagaatgagttagggaggggtccctcctctgcaattttttggattagtttcagtagggatggtatcagttcttctttatacatttggtagaattcacctgttgcttatttatttattttttttgagacaggatctcactctgttgcccaggctggagtgaagtgatgcagtcgaggctcactgcaccctcgacctcccagggtcaagcaaccctcctgcctcaacctccctagtatctggaactacaggcatgtgccgccatgcccagcttatttttaaattttttgtagagacagggtcctgctatgctgctcaggctggtcttgaactcctggactcaagtaatccttctgcctcggcctcccaaagtgctgggattacaggtgtgaaatactatgcctgacctttttggtagtcttttaaattactgattcaatttcagaactcatattgatcagttcagggatccagtttcttcctgttttgatcttggcaatttgtatgtttccaggaattcattcatttctttcagtttatgtagtttgtctgcatagaggtgtttgtaatagtctttgaggcttttaaaaaaaaattctttggggtcagttgtaatgtcccctttttcatttctgattgtttattgagaccttgtccctttttttctttattagcctagctaacagtctatcaatcttatttattctttcaagaaaccaagctctgcatcattgatcttttgtatgtttttttgtgtgtgtgtcttcattttccttagtttagctctgaatttggttatttcttgttttctgctagcttgcttgcagaaaccatgtgcagaaggggttggtttgctcttgtttgtctagttcctgtaggtgtgatgttaggttatgaattttatatctttctaaatttttgatgcgggtgtttagtgctataaacttccctcttcacactgctttagctatgtcccagagattctttgttgtatctttgttctcattagttttctaagaattttatatttctgccttaattttattgtacctataagtcatgcagaagcagtttgtttaattaccatgtaattgtgtagttttgagcaattttcttggcattagttcctatttttattgtgctgtggtctgatagtgtgtttggtgtgacttttttttttttaatttgctgaggattgtttttatggccaataatgtggttgattttagagtatgtgccatgtgcacgtgagaagaatgtgttttctgttattttgtggtagaggattctgtagaagtctgttaggcccattttgtcaagtgtcaagttcaagtcccaaatatttttgttagttttctgtcttgatctaatattgtcagtggggtgttgaattctccttctattattgtgtggttgtgtaagtttcattgtaggtctctacgaactcattttatgagtctggatgctcctgtgttggatgcatatatatgtaggatagctaggtcttcttgttggattgaacctttaccattatgtaatgcccttctttgtcttttaaattattgttggtttaaagtttgttttgtctaaagcaaactatagcaagccctgctttttttctgctttccatttgcttggtagatttttcttcattccttttctttcagcttatgggtgtcatcgcatgtgagatgggtctcttgaagacacatatggcgtcttacttctttatccaacttccactttgtgtcttttaattggagcatgcatagttttagcctgtttacattcaaggttaatattaacatgtacagatatgattctgatatcatgttgttagttggttactatgcagacttgattgtgtggtttctttgtaatgttaatgatctatatacttaagtgttttttttttgtggcgcccagtaactgtctttcatttccatatttagcactcccttaagtatttcttttgaggcaggtcttgtggtattgaattcccttagcatttgcttgtcccaaaaggatcttatttctcctttgtgcgtgaaagctctgttgttatttccttagcttggtctgttctgctgtgaatacttgcaattgtattatgaaattcttatagtgtgtttttcagctctgtgagtgagatcagttctattctttcttgtaatgaccatttcatttttcagctcctgtatcattgccttatattccttagatttcttggattcagtttcaactttctcctatatctgaatgatctttgttcttatctgtatttctgaagtgtgtcatttcagccatttcagcctggttaagaacatttgctggggaactagagcagtcatgtggaggaaagaagacaatctgactttttgagttgtcagagtttttgttatggttctttctcatctgtgtcagctgatgtttctttaactgtgttgtaatttgaatacagtcagttgactccttttctggatatttttagaggaaagaggctttgtgcagggtctttatttgtagttgatgatagttctgttttaaattctttgagaaatctccaaactgttttaaactgtggctaaactaatttacgttcctccagcagtgtatacctttaccattttaccaatgtagttttatcacatttttgttaattcaatgcgcaggtttagagtgctatgtctatgttaatagtgttcatttcttaattttgtggggaatcaggatcacatattctttcttgcacactgttctatttttcttgagttaataattgtctcatgattttcgtttgacagttttctatgaattaatcaccaatttaacccatacttgtcaaacctgtacaatattaatatggtaaaaacgttagatggtctataaatgtataaatgtcttcttctatttttcctgttgacttaatgctctatggtcttcatgctccatttgtagttttgtggtcccctagagccaggggtcactctctggtgattcttttacttatatccctgaagagtccctactctgcttttctgtgttggaacttgtttcctggattctatgttttatctttcttggtttatactcttgttttagagaagcatatcttccagcaactttttcagggaacactttgtaggtaagtgatttttagagcttgtatgtcttaaaatgtcttttttttttactctcaaatttgattggtaatttagttgggcataaaaacataaatttgaaattagtttgcctcatgtaccatggtatattcaatccagcatgccaatatattgactctctctgtctgaaatttttaggctgagctgatagcttttagctgtgagcaaccctgtctatttactccagtatgtctgaaaagtatttttatttatttatctcctgtcttcaaaaagtttgggaagaactttatttagtttatagtgttcttgttgataaactccttagataaaatttctaatttttcaatgtagcttccccgccgcttttccttctcactgataaactttacgtttcttttttagtccaaatattctgagattgtatgaagacttaagttagtgtgatacttaaaaataaacattttggaaaatgtttttggattacttctttggtaatttcaaaccctgccttgtttttttctttctagaactcctgttagccatcagttgaaccccctgtatgaattcctaactttataatcttttaggatattttttcttctactttctgggatattttctccatttgatttaaaatacttctttaaagattttttaaatcatatttttaatttttgagaactttttcttattctaaatatgttcattaaaatagtttttttgttcttgttgcatcttcttttatcacattgagacagtcctttattttaaagtttatataagcattttcgattcctactggtttttatttttttcttttgtgtgatctgtcttttatgtgtaaactttccccagtttgtaatgattctaggctgttcattcatatttaaaaatgaggcactagaatggtgatggaaagtgccatgtcaaagggggtggcttgtaaagtgggagacatcactctaggataatcgggcagtaagccaatctcccataagatgattctcagttattggcatagttgcacatcttttcttttaggtggttcaatttctccaaagcttacacaatagaattcttgaaatacctgctaacaacacacagatggaaaggaatagacctgactgccagcattatggaaacaaacaaaaaatgaggtgatgaaaatatcattgttcaaaaataacaggttaaattaatccccactatttccagtaatgttgttacatccataccatcagctgtgtctattactggaagctctgtatcagtctggttttatttcttcagactagtcaatctctagctttctactgacataggagaggagtggatgcctggctggggtgatggagagagtgtgttagaattcattcttgctcaaaattttatctaaacccatctgcatatttttagttcaacctctcatgcttatagtcagatgcttatacctctaagtcatgagactttgggggattctgtgaaggaaattaactttaccctcttttgatttctttttcttgaagtttaagcttaaacttttccttctctgctatgccatataccccttgtctatttgctttcttccttctaactctttctcatctgccgttgtttccttttccattcattttatctatgtggttgtatatttttatattatctactctcatttcagtggtgttttggctctacttttcactggatattccacagcttgatagggaagtcctaagaaagtccaagctggtgggaattatacacacatttagaggtgtatgtcagcatagaggtctggtgtacagagcagataacaatttgagttgtttgaaccagaacttgtggaatgagtggaatttgacagctagcaactgaaagaagagtgttcaaatacttgcttgatatagtctcctcacagacatcagacacacaaatctttccatgttgaactttgaaatattatagctttgagtaaatgaatgtatcataaaaatttttcatcatgatacacagacatgggtaaggtgagatgaataataactgaagtaaattaatagactgtgtgttctcttttgcttgtgttgcatgtattgtgcacacctgatttgcttacatctttgctactcaaagtgtgatccctggaccacagtatcaacatcatctggatcttgttagatatgtagaattgtggccccatctcagacctactgaatcagagtatgcattttaagaagacgcctagatgacttgtaagcacaggaaagtttgagaagcactggctgttgttatgcattcatcattaggttatacattctttatttcctccttttcctattagaacaaaacaaaacaactacacatgataagtatgtggtataatagagacatcatttattctagtcaatacattatctgtggttacttaaattcatggagtgcagttttatgatgcagataaagcatgaactgtttggtgttttggcatgggttttggaagcagatggacttggtagcaaacattgcatttgacacagattcttaattacttttacccttggtaaaataaaaatttacatagttttctttactgagttcttatgaagattaaataaaatgatgtttctaaaatgcttagcacagtatcgtaggcacatgcaattaatattagtacccttttcttcctcaccgaaatgagtgtcaaaattttaaggcattacaactaatggccagggaatttgatatggaagattttatttacctattttgtttaaaaaattatttgatactgttgagctttttaaattttttaatttttatggatacatagtaggcatgtatatttatgagtaacatgagatattttcatacaggcatgcaatgtgtagtaatcacatccatgttgacatatacatatatccataaaactgtaatcacaattaagacagtgaaagtcttcatcactcccaaaagcttcttctctattgtcaattccggcttcctgccctgtcaccaggctaccattgctctgctttctgtcactgtatttgagttttcattttgtagagatttttataaatggacatatgcagtatgtacttttttgtctaacttattttacttagcataattaattagcattaattagtgtgagattcattcatgttgtagtgtgttcagtccttttatcactgagtactattccatcatatggatgtatcacagtttgtcaatccattcacacaattcacaatttggttgctgactctttctggctttacaagtaaagctgctgtgaacattcacggacaagtcttgtttggaaatatactttcttttccttaaaattgaaatgttttgattatgtgggagttgtatgcttagccttttacaaaattcacaaactgttttttaaagtcattgtacccttttacactcccattggcagtgcatgagagttaaaatacctccacttccttaccaacacttggtatgatcagtcttttaaattttagtcattccaatagatgtgtagttgtatgctattatggatttaattcgtttatatgagtaataattttgaacacctatcttttcatggacttctatgtcatctgtatttttgttcataaattgtatattcaaatctttcccactttttaaattgggttatttgtttattatttagtttataattttcctgtatatacaggatacaaactctttatcagacatacgctttgcaaatatttcctcctggcctctggactgtcttttcattcttcttaacaaagtaatccaggagaaacattttaattttgatgatattttgtttattttttttgtttgttttcttaatagatcctgcttttggtgttgtagctaagaaacctttgctaactcacagggttgcaaagatttttgcctatatattttttctatgagtttaatagatttatgtcctaaatttaggtctataattcattttgtgttaatttttgtatgtggtgtaggcatatactgaagtttattatgattacttttgcataaggggacctaattactccagcaaaattttttatgaaggctattctttttccattgacttacatttgtatttttgtcaaaaagtagttgtataaataagtgggtcttcttctgaactctgtattttatcccagtgttctatttgtccatctttataccaaaattaactatcttggttatcatagctttacagtaaaacttaaatttaggtagtgttagacctttaattttgttcttttttttaaaaaaaatgtttttaactattctaggtcatttgcctttccatatgaattttagaatctgcttgtcagtttctcaaaattatgctggaattttaaccaggattgaattgagtctatagatgaattaagggagaattaactttttaattattttcaatgttctagctcatggtatatctctccatttattttgtcttctttgtttttccttaacaaatcctgttgtgttcattctaaaagtctttcacgtcttttttcagatttatccctaagattttaatactttaaatgcttttgtaaattgattcttaaaaattttgatcttcaataatttgttgctcatacaaatatatataaatatacatttaatttttgtaaattcatcttgtatcatgcaaacatgctaaatttactttttagtatttttatagatttcatcagattgtctataaatcatgttatctgtgaataaagatggtttaattgtttttgtatgtcttttatttattttattcattcttattacactggctataacttctagtataatatggaatagaaatgatggaaggtaacatctttgtcttttccttgatcctggaagaggcgcatttaatctttggcaattgagtgtaatgttagctataggttttcatagatactttttattaggttagagaaattttcttttattcctactttggcaagagcttttaatcaggaatagatgtcagatttgtcaaatgtttttctgcatctattgagatgatttttctttttaatttttttgaatttagtttttgtaaaaattctagtcatatagtaaattgcattgcttattttaaatgttaaattaaccttgcataactgagataaactccacttgatcaaaatatattacctttttatctattattggatttaatttgttaaaattttgtttaacattttgcatcagtttttatgaggggcagtggtctttagtagtctttttaaaatttgtctttgtcttatatttataggtaatcataacctcatagaattattcagaagtattctcttattttcaattttctggaagagtttgtgttggatgggtattatttctcacttaaatgtttggtagatttcactaatgaagccatctaggcttttagggttttttattagaagatatttaattacaaattcaatttttaatatacattagggccactcaagttgttcaatttagtatcataaggattttttttaaactgtattctattattaacttcttaatttgtatagaatcagtggtaatagcacctttctcatagttgatattcataacttgtgccattttttcttgatcactctgcctagaggcttatcaatcttattattgatcttctcaaacaaccagcctttgatttcattcatttttctctaatgtttttatttttacttccttgatttccactcttctttctttattctacttagttttggtttaactgactcttctaattgctttgcatgggagatgaggtcatcaatttgataccattttgttttctaatgtaggtgtttaatggtatacattttcccctaaatgctgattttagaggcatcccacaaatactggcatgttgtactttcattttcattcagttcaaagtactttctatgtttccttttgattccttttttcatctatgagttatttagaagtgttatttttcaaatatttgggattttcaagaaatatttctgttattgatttccaatttaatttcattttaaccagtgaacattctttgtaggactttaatcctgttaagtttattgggacttgctttatggtctggaatatgatctaccttggtaaatgctccatatgcactggagaagaatatgtattatgttgttgttgggtggcatttttttataaacagcaattacatcaagttgtttgatagtattgtacaaatcttctgtatccttactgatattatgtcttgagcagcattgaaatctcttgactataattgtacatttttctatttcttcttagatttgtattcatttttgtttcatgtgttgtgaagctctgttgtaatgttcacaaacatttagaattgttatatgttcttgattgatacttttatcatcatgaaatgataattatgttatcatctgaaacctactttgtctgatagctttcttttgattagtgttagagtggtatgccttttccatccttttacttgtaacttatgtccttatatttcaagtgcatttcttacaagtagcatacaattggatcttgttttatccaatcttacaaattttgcctttttttgagcatgtaaattatatattaggttggtgcaaaagtaattgcttttaaataaatttatcatacctttaaaagcaaaaaccacagttacttttgcatcaacctaatagtataaagtaaataacataaaccattttatgtgattaatgttcccttctgctagttctatcattcaaactgctgtcatttttgattgattaatttttctcttctttatgggtcatatttttctgcttctttacatgcctgctaattttttattgaattccaaatattacacattttaaccttgttttgtgctaattatttttgcatgcctataaataatcttgaaacaaattgcttgaaataatttgattctttaggatctcgtttttaagatttgttaggcaggactggcaaagtgctcagtttgatgataaatacttcccactcctgaagcaagaccccttttttgtactttactcaatgactaatgaattatgaatatttcagtctggctgatggaaacaaagtgtattgctggtcctgagcaccagaaacggttatctttaatcctttaaaaaaattatttatttatttatttattttgagacagtctcgctctgtcacccaggcaggagtgcagtggcgtgatcttggctcactgcaatctccccctcccgggttcaaacaattctcctgcctcagcctcccaagtagctaggatcacaggcgcccaccaccacacccggctaatttttttgtatttttagtagagatggggtttcaccatgttggccaggctagtctcaaactcctgacctcaggtgatccatctgcctcggcctcccaaagtgctgggattacaggcgtgagccaccacacccggacacctttaactcttttgggtgttttcttccatggtctcaggtagtttcctcaaatgcctgtgttgattattactcatctgaatactcaagcgaagcacactgacaatttccttgccttgtgcagccttctctggcactctgtcctgtggtttctagctgtctttcagagtctaagctttttcccaactcagcacgtccactggactctggtgcagtctctccttcctgtgccatggcctggactcccttaaagcagcaagctgggataatcataggtctcgctctgttgtttactgcctttcatggatcagtatattacattgctcgatggccagtgactggtacctcatcttgtctggaagcacaagtcaaattagaagattcctactcatctttttttttttttttttttttttaacattttcaaccatattaggtgaactactctagcatttttcactttattagatttgtctgttataaccagtttataattaatgtagaaaatgtctttttatttagcttttcctgaggaatctccttgttttgaagaaaacatggattggaaaatgatcagtgataattattttcaatttttgaataacttactcaagtctccaacagcttccatatccaggtaagttatcagaatccaacttctaggtcttgatttaattatcatctgaagataatcaaaacctaattataggatatgcactctttaaaatttatgagcctgatttagatattgacacaatctttcatatgagctgttcaataaatattcctttaatagagtgtgtgactcaagtatcaagttgtttaatagaatgtatgactcaatggattttgaaaggaaatacagatcgtagtaagaagattttccttcaataataacatgatttataatagatgctccaaaaataaggtatttgttttgaaaaattgtcttagctagttacctagagtttaagcaggaaatcaattctatagattctgttagtttcaaagactcctgggagagagaagtggtctttggaactaaatttgtcggactattttctgctgtcctatttcagcacgtgtattgaaatgcagatttttatgtctggttatgaatagtgtgtccagtttaaaggtatactcggttatttgtggggtgtattggaacatgatgggagagatgttttgcataagagcagtaacgctcaaacttgagaatggattaaatctgtgaagactgctaaaaataaaaatgtctgcaccttgccccagtcatatgaaatcttgctctgtgtacaggacccaggtttctatatatttcacacattctataggtggttccagtgcacaccaaagttggagaaccattctgctatatctgtctagaatggggattagtcattcctatggaacttcttaagcccagctattagtaggaacagaagaaaggacaatgggatggatcctctagagaatcaattccttgcttaggtcagatttttaattcctctttcctgaaagcctcaaaaatttaatagccctagaaaaccagcacaaaactagtctatatgtgcacaaggacacatttaattttatatttgtggacccatagcagttggcacagtgtctttcatcatggatagtggtagataattagatgttgatttaatgaatgaaaaatcattgaacattaagtgcaatttatattaagaaagctgaacttgaaatgacaaaacctgggtcgtctcctagtcatgccacataataacagcttgaacctgtcaattaaaaaaataaaaagtttcttttttcatgaaagggaaataatgacgtgtacttcaaaaggctgttgtaggaatgaactaagatagtagttgtgaaagtgctttataaactaaattactaaagtaatataaaaacgtggcaataatactattagtagtactacttctacttcaatttattattctattgctactccataaccctctcagttcccaatacaaataagttttatattctcctctatcaaggcacaatgacttggatggtagttaggcatctattcttagggagggctggatttaggcaaggtttatgttgaattcctaatagaactttcccttttctgatgggattttttccctaggaattatttcaaagaagccattctgtcctaaaaataacaactaactaaattaagaccatatttttgtgtggggtgctcaggtctcagctatcagggaagtaaacagcattcttgcctttgataggtcttatgtctgtcctatgtcagacagtgtgttatacaacaagagcagagggttaaaaaacttaggaagtaatttaccctgtaaggcataaatagccaataaaggtcaaaaattccttacccacaattctgaactcttacaaagtctgaaaatagaggcttttcttatggttgacatcacaactcattcagcaaagatttatcatgaactgatgtgaagcagtttcaagtgtattatcctgcgtcgcgagatcattcacaggtctcactgcgaaagtgttaatacggtgatgatcagggctgtcccagccctcactgagatgcatgaatacatatctgatacctgtatcatgctacatttctaaaggatgaacatcctgaattctgaaacacatgtaaccccaagaatgtcaaaagtggacttgtaagttctgagttagtagaagttagttctgcaagtgtggatttctgttacaagaggggacttacagtgtctgagttgctcttctgagaactctgtattttaaaattaaacacctggcgataagctaccccatatataataatgagtttctgacagtaggatgtatatagtattgttgaaagagcactggaatttgccttccaggactgggagtgcccacaccttgctgaaaccctacaggcatggtttctaatgcactccactatctgtgctacctttacatgccaagacattttgaaatggaattaaatcctaagattcttctggcataaatagcaaacttatctttaataatcatacatattattgttaaatatgccaggggaaaataattgagaatgctttctttttggtggtaggaaacattttaagctaaatatatataacttcattgtgcatttctaaaacactttcaaatcctcacattagtttaatttctgttggaaatcatgttgtctattaaatgtttcatttgtgttttactatcaataaatgagtattaacttggaaatttgataaatcaaatttatttttttattttatactaaaataattctattaatattacagggctttaaatttcacaaagcaccttctaatgatggaaaagaagttgcacacccttgaggatgaacaaatgaactttcttttatcatttgtggaattttttgagaaattattgttgcctaatctttttgactcctccattgttcccagtttccacagcctcccatctctcacagaggatattctgaatataagttctctgtggacaaatcatttaaaaagtttaaagagagacccatctgccactgatgctcagaaactcttggaatttggcaacgaagtgatttggaaaatgcagactctcggaagtcactggataaggaaggaaccaaaaaatcttttgagattcatagaattaatactttttgaaattaatcccaaattactagaattatgggcctatggcatttcaaaaggaaaaagagctaaattggaaaacttctttacacttttaaatttttctgttccagaaaatgagattctgagtacaagttttaacttttcccagttgttccattcagattggcctaaatcaccagctatgaacatagattttgtacgtttaagtgaggctataataactagtctccatgaatttggatttttggagcaggaacagatctcagaagctctgaacacagtctacgctatcaggaatgcatctgatcttttctcagccctttctgaaccacaaaaacaagaagttgataaaattttgactcacatacacctaaatgtcttccaggacaaggattcagctttacttctgcaaatttattcttcattttaccgatatatttatgaattattgaatattcagagtagaggctcttcgttgactttccttacacaaatctcaaaacacattttggatatcataaaacaatttaatttccaaaacatcagtaaagcatttgcatttttatttaagacagcagaggttcttgggggaatttctaatgtatcttactgtcagcaattgctttcaatttttaactttttggagcttcaggcccaatccttcatgtctacagagggccaagaactggaagtgatccacactactttgacaggcctcaaacagctgctcataattgatgaagattttcgtatttctttatttcaatatatgagccaattcttcaacagttcagtagaagacctattggataataaatgcttgatttcggacaataaacacatttcttccgtaaattattcaacaagtgaggagtcttcatttgtttttccattggcacaaattttttcaaacctctcagcaaatgtcagtgtgttcaacaagtttatgtccattcactgtaccgtttcatggcttcaaatgtggactgaaatctgggaaaccatatctcaattatttaagtttgacatgaatgttttcacatctcttcatcatggtttcactcagcttttggatgaattggaagatgatgtgaaagtctctaaaagctgccagggtatacttcccacccataatgttgctagactcatattaaatttgtttaaaaatgtaactcaagccaatgacttccataattgggaggacttcctggatctcagggattttttggtagctttaggtaatgcattagtttcagtaaaaaaacttaacttggagcaagtggagaaatcccttttcaccatggaagctgccctgcatcagttgaagacatttccattcaacgaaagtacaagcagagagtttttaaattctctgcttgaagttttcattgagtttagcagtacctcagaatatatagtcagaaatctagattcaataaatgactttctttcaaataatctcacaaattatggagaaaaatttgaaaatatcatcactgagctaagagaagcaatagtatttcttagaaatgtatcacatgatcgagatttgttttcctgtgctgatattttccaaaatgttactgagtgtattttagaagatggctttttatatgtaaatacctcacagaggatgttacgtattctagacacgttaaattccacattttcctctgagaacacaattagcagtctgaaaggatgcattgtatggttagatgtcataaaccatttgtatttgttgtctaactccagtttttcacaaggtcatcttcaaaatattttggggaatttcagagatatagaaaacaaaatgaactctatattaaaaattgtaacttgggtgttaaatataaaaaaacctctttgttcatcaaatggctcacatataaattgtgtcaatatttacttgaaagatgtaactgactttctaaatattgtacttactacagtctttgaaaaagagaagaaacctaaatttgagattttattagctcttttaaatgattccacaaagcaagtaaggatgagtatcaacaacttaacaacagactttgattttgcatctcagtccaattggagatattttactgaattaattctaagaccaatagaaatgtcagatgaaattcctaatcagtttcaaaatatttggcttcatttaataacactggggaaggaatttcagaagcttgtaaaaggtatttactttaacatcctggaaaataattcctcttctaaaactgaaaacttgttaaacatatttgccaccagtccaaaagaaaaggatgtaaacagtgtaggcaattccatttatcacttagctagttaccttgccttcagcttatctcatgacctccaaaattcaccaaaaataataatttcacctgaaataatgaaagctacaggtcttggtattcaactgataagggatgtgttcaactccttaatgcctgtagttcatcacactagtccacaaaatgcaggttatatgcaagctttgaagaaggtaacttctgtcatgcgtacccttaagaaggcagacatagaccttttagtggatcagcttgaacaagttagtgtaaacctaatggatttctttaagaatatcagtagtgtgggaactggcaatttagtggtcaatttgcttgttggcttgatggaaaaatttgcagacagctcacattcttggaatgttaatcatctgctgcagctctcacgcctgtttcctaaagatgttgtggatgctgtgatagatgtgtactatgtgcttcctcatgctgtaaggctcctgcagggagtacctggtaaaaacatcactgaaggcctcaaggatgtctacagcttcacactccttcatggcataaccatttcaaatatcaccaaggaagacttcgcaattgtgataaaaattcttttggatacaattgaattagtatcagataagccagatattatttcagaggctttagcttgttttcctgtggtttggtgctggaatcacacaaattctggatttcggcagaattcaaagatagacccctgcaatgtccatgggctcatgtcttcttccttttatggcaaagtggccagtatacttgatcatttccacctgtctccccaaggtgaagattcaccatgttcaaatgaaagctcccgaatggaaataactaggaaagtggtctgcataattcatgaattagtggactggaattctattcttctggagctctctgaagtcttccatgttaacatttctcttgtgaaaactgtgcagaaattttggcataagatattaccgtttgtcccaccttcaataaatcaaactagggatagcatctctgaactctgtcctagtggttccataaagcaagttgctttgcaaatcatagaaaaacttaaaaatgtcaactttacaaaagttacatcaggtgaaaatattcttgacaaactaagtagtttaaacaagatccttaacattaatgaagacacagagacatctgttcaaaatattatttcctcaaatttggaaaggacagtacaattgatttctgaagactggagcctagaaaaaagtacgcataatctactctctttattcatgatgctccagaatgcaaatgtcacaggtagcagtttagaagcattatcaagttttattgaaaaaagtgaaacaccttacaactttgaagaactatggcccaagtttcaacaaatcatgaaagacctaacccaagattttagaatcagacacctgctttctgaaatgaacaaaggaatcaaaagtataaattcaatggctcttcaaaagataactttgcagtttgcccatttcctggaaatcctggattcaccgtcattgaagacattagaaattattgaagattttctattggtcacaaaaaactggcttcaggaatatgcaaatgaggattactccagaatgatagaaacattattcattcctgtgaccaatgagagttcaactgaagatatagctttgttagccaaagctattgctactttttggggctctttaaaaaatatatctagagcaggcaattttgatgttgcctttcttacccatctgctaaatcaagaacagctgactaatttctcagttgttcagctgctttttgaaaacatcctaattaatttgatcaataacttagctgggaattctcaggaagcagcttggaacttaaatgatactgaccttcaaataatgaatttcattaaccttatcttgaaccatatgcagtcagaaactagtaggaaaacagttctctctctgagaagcatagtagatttcacagaacagtttttgaaaacattcttctccctttttctaaaggaagattctgagaacaaaatatctcttctgctgaaatatttccacaaagatgttattgcagagatgaggtgagtatacttttgctttgtgtcatatatgcagttgcgatatatctcaaactactttattttctggagtatagacatgtcaaaaacagtatttgtatctaatacctttgaaagatctttgatgtaaatttgtcttaataaatattttatcaaaatgtcaaggtaaaagaattttgattactgtcatctagtaaaatataaacccagcccagggtaattaatcacgtattattcttacatttttagattatgaaaacaattatgaattctattttatatggatctgaaaaattagttttcatagctgtacatgcatatacaggattgacataatttgaattgctatactaactgtctaatcaccaactaggggcttaagtattctcaacccaatgaatctactgtggtatttgcatttagagacataaaaattgataatcacattatcttcttttcatatatctttaaaaatctcgtttgaagtttgccagtgaaaaggctggagggaaattccaatttattccatgatgtctgctttagtcaagtttcaagcagagtaacaaaaatcatcaaaggatttaatccaaggaaatcagcttacacaattttgggggctggctgagtaagtctgcaatcagtagggctgactgtcaggaagggaggcccacagtaggcaggggcgcccacagcaggcaggggcgctgcgggcatgagtgaaagctccttgtccacagtggtcaggaaggaagaccaggggaagggagagccactgactatgaatacccagcagtggttttgtgcctctaagttacagaggttctatgccctctttcagagttttcctggcccactcaggacagtatcccttctgactaatttaaagttaactgatcagggattttaactccatctgcaaaatctctttatagcaacacctaggttagtgttcgattgaatagctgggagaagatgtacttatattacaaaatggctataactcccatctatcctagaactctcatgagagaatctcccctgtagcccacccagatgagaaacatacaagaaaggggcttcttcagctattgtttagcctagtcatgttgatacatctgtctgagcaatttgctagtacttctaaagctcagaaaaatataaatatgctaaccacttttcagacacttatctcttacatcaagaatcacattgtagtcattttactttctttcctaagtaaaagcccttttaacctttttcataagcaaaagtttgtggctttttaagttgctaggtttaaagaactgtaacagaatttgttcatgaaattcctcactcttttcattatttggcaacaaaatattgagtttcatctgaaattattttagcatgtcatcttttgctcagtattatcttcccatgatgctattataaaacaaataaaataatataaatcactatgtatcttaatatttccactgttaatgtattaaaaattaaattaaaagtatatatatatatatatttacagttttgtcccaaaagataaaattctagaaattctgaaactggatcaatttcttaccctgatgatacaagacagattgatgaacattttttcaagtttaaaggagactatatatcacctaatgaaaagttcatttatattagacaatggagaattttattttgatactcatcaaggactgaagttcatgcaagatttatttaatgcccttctcagggaaacttcaatgaaaaataagactgaaaataatatagactttttcacagtggtgagtcagttgtttttccatgtgaataagtctgaggacctcttcaaactcaatcaagatcttgggtcagctcttcaccttgtaagagaatgttcaacagagatggcaagacttctggatacaattttacactctcctaataaggacttctatgctttgtatcctaccctccaagaagttatacttgctaatctaacggatttgcttttctttataaataattcattccctctaagaaacagagcaacattagaaattactaagagattagttggtgctatttcaagagcaagtgaagaaagtcacgtcctgaaacccctcttagaaatgtctgggactctggtcatgctgttgaatgacagtgctgacctgagagatcttgccacatcaatggactccattgtgaaacttcttaagctggtcaagaaagtttcggggaagatgtccacagtttttaaaactcattttatctccaataccaaggacagtgtgaaattctttgacactctgtattccatcatgcaacaaagtgttcaaaatcttgtgaaagaaatagctactttaaaaaaaatagatcatttcacatttgaaaagataaatgatttgttggtgccatttcttgacttggcctttgaaatgattggggtagaaccttatatatcatcaaactctgatattttcagtatgtcacctagcatactctcatatatgaaccaatctaaggacttttctgatattttggaagaaattgctgaatttttaacatctgtgaaaatgaacttggaagatatgaggagtcttgcggtagcatttaacaatgagactcaaacattttctatggattctgtcaacttacgggaagaaattctgggttgcttagttcctataaataacatcaccaaccaaatggacttcttataccctaatccaatttccactcatagtggccctcaagatataaaatgggaaataattcatgaagtgatcccttttttggataaaatattatcacaaaacagcacagaaataggatctttcttgaaaatggtgatctgtctcaccttagaagctctttggaaaaacttaaagaaagataattggaatgtttctaatgtgttgatgacatttactcagcatccaaataaccttttgaaaaccatagaaacagttttagaggcctccagtggaattaaaagtgactatgaaggtgatttgaataaaagtttatattttgacacacctttgagtcagaatataactcatcatcaacttgaaaaagcaatccataatgttttaagtagaatagctctctggaggaaaggacttctgtttaacaactctgaatggataacttccacaagaactttgtttcagccactttttgagattttcattaaagcaaccaccggaaagaatgtcacatcagaaaaagaagagagaaccaagaaagagatgattgactttccttatagtttcaaaccatttttctgtttggagaaatacctgggaggattatttgtattgactaaatactggcaacaaatcccactaacagatcaaaggtaattaaaaagctgaattcactttgtttttttctctaccgcagtagctataaaatagaaccatgcaggaattacagtgaatcggggtaagtagttcttcttgacttcaactttgtttacactctgaagttggcttcaacatagagcaattcaggtccagtcattctttttcataattcgactcattatttggcattcaaatataattgcagtttattcaaaatatttcaaaagtaagttattttattctcagaagcaaaaacctcttattctattcactcatcccaagactagttgcataaacaatttttctgttcatatcctctggcagccaagggtcctatgactcagtatacacacaagaacatgaagctgcttgcttcacagaaaattatgctttcagttgtagctaaccacaggaaagggccaggcagctgctggcttctgcccttttttgattctgccagacttcacgtggttgatccacctccaagccctcctatcgctgaaagttatgtccatagaaacctgttcttaaaagctccagtcttgctagttgtcatgccttggaagcagtctgttgccttaggttggagaccctgtgcctcttgatgtgcagaggcccagagatgctgcagctgtccctacctgtcctttctgtgggtgaaaatactgttagggtggtccctggtctctgtttctccctgctttcctctctggcccacatggagattggagatgccatgtcaaccctggttcatttgccaggcaggctgacttattttctgttggttctattactccagagatgtaccttgaatccagtcatgttctatgagttggaaagatgtctttagttggtgaaacaggtagccactggcacaaataactattgctacctaggaatttgactgctagttttcagagcttccttcttcatctcctccttgcttctgatgtcaaactatattttgtttgactttagtgctcttctctgaattgtcttttgagctgaggtggtcctggcaaccccattctccaccaatctcaggttttatctcaaatttttcagttctccacagagggagtttataccttagctcttcataccatcatgttttgacaccttttcaacatttacctttgcatttcaaaagaatagaacaaaagaagaaagaaaagcaagtattaagcttattggccacaaaattgatgctttgaaataattctggagacctaaagttttctaaaggtccagaatgtgttatctgtgttttcttatgttcctatgaagaaaatatgattatgcagggagggaggatggttcttacatgtgtgttataacttaacctacacagtagagatgcacatgggttgcacatttttacccttttatgtcattgtatatatttttttgctaagtgttgttgagatttgtgaagttttccagcagactgtgaagccctcagaagccatggagatgctgcagaaagtgaagatgatggtcgtacgtgtgctcaccatcgttgcaggtgggctgctcatataacaagtgctctgcaattgccctgtgccagttttcagaactcaggtgtcagagagatgagtatattgcacttgagtttcttttagaacaaagcacagctgtcttagtctggcaaccaggccttgagggatctgcccctcccaacctcattcccaccactgggcctctactccagccaaattgaacggcccgttcctgcgcctttgctgggttttctggtctctgtctttgctcatggaatgtgcttcccttgtcttcttgacctaaactacagccgtactctgtggcctagagctgggggtgtcttgtccagaagtgttcccccatctcctttactggcaaagaccttgaggagactttgatcacgtgcagtatcgtactttcttctttcttacatttcctccctctgctacagtcaatattttttgaagatagaaactgtgtcataaccttctgtgtgcatttcctgatgggtgctgagtagtccctgcagtaacctgaattccctacagccgtggcacttattgctggtattatagtttttggtgtcttcttttcctgctgcagtctgtaagcttactgggaacaggatcagtctcttgctaaattctgtgtctccataatactcagcatagtgtccagcaatagtgactatattgtaaatgaattaattcatctgctaagatgatacttgccaaatccattcctgcacatttcagtgcaatctcctttcaatgccactgctgaaggagagtcccacgagctgctttagagggtaactagatgatcttagggcttttctgaaaatgtgaacattagactttagagcacacttgagtccatggaatggaccacagttgtttaagtaattcacaggtgcacagaggtgctgccatcctctggcccagtctcctgagcagggctgcccagagccccctcagtgggctactgggcctgagtaccctgtcttagctgatggcagtgggttttgacaacatgaatcgaagcccagaagaggaggggaggcgaggagaaatggggaagccaagggtggatccgatcagatcaagagggaaagaaaaaagtgaggggtcatctgagtagggcttactccatatcctggccccggactccctgccccctagctcatctgatccacatgttcattcttctgcctttccttgatttactcctggatcattattattatttcgattactatcaggttgttatattatgatttgtagattacgtgttatttcctctggaaagcttttcttcacctaccctgtctggggtcacatggccttagctccttgttatggctcttaccaccgtgtgctattctgatgatgaacatgtgtctcttctacagttgtgagaacccagagactgtgcctgtctattgatcactacaaacctggcacatggggattagaacatgggaaatgttgattgacatttgttgaatgaatgaataagtgccagaagctcttctatacttacgtcatgtttcactggaattaccaaatgtgaaatctgttcatgggggagtgctcagcagcgagaagtagtgggtgggctgttggcatgttctgggcctattttgtacgactgagcaaactgtgggggcctggggaggatgttgtagagaggagtctggtttacccaggaaggggcacagtggacgtattcccaacatccactatcagaagaggaagggttaccggccccaggatggctaattggtgggtgtgggccactgagtctgtgagccaggagtatggaccagcatctactggggagcggtatggaggagaaatgagccttgggcagaaccagcatgtcaaatccatttttcaaaacaaaaaagataaatttttctttgtattgataagtgctagaaagaagctaaagtatggccatgagggtgagagtgaggggtggaggagaggagaagaccttgagggtgcagttcagggtgaggacatttcaggtgagacttgcgtagtgaggatgtgtgtctgccatgctcatggttatatcttcccagggtttaggaaacatactgacataggcatgataggcattcaatcaatatgtgtagaaggattggataggtcaatgcatgagggctggcactaggttgggcacttgtgactgcttgagttaatctacacaatcactgatgggcttcagactagtgtgctgggactcgtggtctgtaaggctgcctccttactgtcacgatggggcactcaggattatacaccttcatgactggtaaggctttattgccccaaatatctttgagggcagagtcaaacatgactgttaaaacaagtgatgtcgtgagaagtgctgtaatggaagaagcaggcgctttgagattgaacaggctgagttccttgattcatgctgagtgacacagggtagcttctgaatctctgtgagccttgaagaaaacataggggaacacctatttcaacctatgtgagaggattaaataaaatgagtcacctccaaggggcttatcctaaggagatgccttgaacatgctagttgccctgtcctgcaagttgaagatgcatctccctgcatgccattgggaaaactacttctcagcttagagggctagttcataagtaaaaactggtaatttagggactgtctatcacagggttagttctaatctgctcactcatccctttttttgtaatacaaatggttgtttgaacagaagaattgattggtcattgggtctaagaaacatggaaaaggagtaagaaacagagggagaagtgggacaagcttgatttaaaaatgaaaccccaactgctgtgtaggggttttgcatgtttttttttcttttaagataatctgtatttccaattagatgttatgaacattggtgattaggaatattgctttctgttgtcaaatagaaatcagtaaagtgttacaatctaagtacaagttaggatggttggtacatgatttcagcatttggaagtgtgctcaggtaaaattcaaatcaaacttcttcctcgttcttgaatgcttatcttccatattgaattcagccacgtttgaagacacaattatctggacatttcacagtcagctaatataatggtttttaaatgaattaaacattcattaatgtatgaatttatatttattttgccattctgtattgcagctgctaaattaatatagcatacttgagattacattagtaacagataattaatttttaatttttatattttatttcaaggaaactcaagcataactaacatttaaactgccaccccactgtccttattgaattgttactccatcctgtagaataggagggcagtgacagatcccataaagttaaagggatggggtggaattgaccaatgtgggcaaatagcccctcctctcccatcatataaagggaacaagaataagatctgttattattattgttgctgaaaatgcactatattttcgtcatatcacagagttgagttcagtatctccaggaggaaagtgacaactttccttctcctgatctagtgctttaaagatgccaaggacaatgcaggagagctcatgcaacggaaggagcctcagtgggcagctactttaatcttccagtttccctaattgacgaattgaggcccagagagtgagagtgagtttcccagggtttcagagtgaagcagtcagagcccatttccagttgaagagacctgagagggtccatggggctgaagggaggagaggaaaggggtccagagagcgctggcagatctggaaagccagagtgggtctgaatgtgtccttggagccaagaagaggggccacagcaagtaggaagggctggagccagggattgggagaggcaatgagaggtggagaaagagggtacccgggaaagttggaggagtcaaggctcaaaaccagctcttgttagtgtcgagacagttgtcaagtgtccttgagggtggtgcctttgagggcaggcttcaagacgtgttagatgtgaggcacatggaggccagatggcctgacagcccagcactgcatcccatgatcatatcatccctgacctaaccttgcaggaatgctgggcttggtcactgtcgactccacgttgtcattttacattgaggaagcaaggggctgacacagcccacagcttgcctgatgccatacattacatcagctttttcagggtgcattctctgctcttttaggtttgaacaacataacttataaacacattattgtgtcttcccgagaccagaggatatgtttatgcttaaagataagtgctgtgatatataacagcacattattaccttcatttcaaattttaataagagattacttaagtgacacattttatatttcctacaataaagatacctgtctttgaaattagtaaaataagattaatgagaaaagaaaaacaaataaggcatcaaggtgggttgcttctggaaagcatgactttggatatattgtgtctactctgcattttatgtggttgaaaactgttttagtaattaataaattttatattttagagtagttttagattcgcagcaaccttgaatggaaggtgcagggatttcccatatactcccttccccaccatagcctccctcattatcagagtggcacatttgttacaattgatgaacccacactgacacagcatcattccgagtccacagttcacattgggcttcactcttggtgttgtcattctatgggttaggacaagcatataatgacatacatccagtgttacagtatcacacacagggttttactgcctgaaaaatcctctgtgctctgcccattcatctctcccacccctctagcccctagcaaccacggatctttttactgtctccatagtttttgtcttttccagcacgtcattgagttgaaatcatacaatatgtagccttttcagatgggcttctttcacttagtaatatgctggaactgttttttcccttccttccttccttccttccttccttccttttttcagacagagtctcgctctgtcgcccaggctggagtgcagtggtgcgacctcagctcattgcaacctctacctcctgggttcaagcaattctcatgcctcagcctcctgagtagctgggattacaggtgcccgccaccatgcccggttaatttttgtatttttagtagagacggggttttaccacattggccaggatggtctcgatctcctgacctcgtgatctgcccaacacggcctcccaaagtgctgggattacaggcgtgagccaccgtgcctggctcagaactttttataaaggacttttgagaaacaatttattattcataatttaagagtcaggataacatttttttttctaattaaaaaaagattttatttcttataaaaatgtattttattttctgtcatgaccaagcatctaggaggtacaaagccctgtgctaggtgccacaatgacaggaaggcagtgataagaaaatttgcccgtggcaggtcttgtgcagatggatttatcgtgcggtgggaggtgagcacacaggcatctgcgcagcagggaggggaggggctttgctcagcctgggaaaggtgggtgtctggaggcagaactctaaaagatacgtaggttcaggaagggagagtgatgccttgtatctgatggccttgaggagacaggagggacatagggcatgactgcagagaggtggaggcacctgaggctgcggaaagacattggatgcaacatggagcctttgcacagattcctgtaatgggggatctcctttggggaagagccttgtggatcagagcgtaaggcagattggaagggtgaggtgggagtgggactgttaagagcacagcagtttcctgggcgtgatctatgggtgctggacagacgcacagatggagagacattgggaggtcatgctgagcagatggggaggttggttggctgtgaggaccagggggaggagagtcatgactggcttccaggaagtgacttgtgaggcatggggcatggagaagaccacacatagacagtgtgtaattcatccttcaaactggggcacttttgagaatgacagagggcactgttcataaccatgcaagaataggtgaaaagcaagtctgtcctgggcaaactggggtgaatgggtaccccacttgtaggggatacagggaaaggagccagtttgaggaggtagagataattaatatttacaaaatcaattaggcccagaaaagcaaaatctttattttattacatttggaactcaaaaggcacagctttaccctcatcatctgaatgttcatcttgatgatttaagaaatgtttaggaatttgtatcactttgaatctttaaaaagtgattttgtgagagtggctagttcaggagaggactgtctattaattatttctctgtgtgtttcctctggcagaaaacccttcctggaccaaggacattttgtgtgctactctgagttgcaagcaaaatgggataaggcatctcattttatctgctatacaaggggtcactttggcgcaggaccacttccaggtttgtcgtctttaatatttcagagaatttcatgttcatgactattggcccttgcaaggcagtccagttattcaaacttgctgcttcgttcttataactacagcaatggtgtcatacacagtcttgttgcaagctgggcttgcagaatgactgctcacccttcctccctcttggcctctcccagtggtgtgctgggttgagtggcactgagttgagagatcggattgttaaattttcaggaattttgcaagctggttgttaaacatagatgtcatcattataaataaattatataaacttatgatgaaataaatcatgttagaaacacaagtaataattactcaagattcatcacttcctaattattttagtatgttttactgttatctctcttcctgagatgatttgcttttgttgtatccacatgatggaaatactatgtagtcttgtgctaagtgcagttcttcccttctctacgtttaatgacgttatggtggcagcatgaactgggccatgcaggagcttttgcaccatggaaattggcaagtgctccaaatcagaattttttttttctggagagttagtttttaaatatttaccagcccaacactggctctaactcattgaatacactggctagtaccaaaaattgatggctgaatgggaaccagcatagcaatttcctttttattaaattggacacatgcccaataggctcccatgcagggtctccaactatagctgaatcagacaatgtgtctcttatttgggccccactcctttgtcctagaattaaagacccctgggcccctaggtaggcctgatccccctgacaagcttggacaatggtgatgtccttccaacaatgcagtgaagacctgtctctcttctagttctggttctgaatgttgtttcttgcttttgtgatccatattatctgtgagtatgagattatcacagaaagcagagaaatagatgatgccgagagagatgagagatagccatgccagactcccacagcatggcaagggtgtcgaatgccatgccttggtgaagtgtcaggagggagtgagagctgctgatctctaatcaatgtcttgtggcctttggaggagtggtgcctgtcagcaggaagccctgagcagtccctagcaatgattgactttacaaccccaaatttacattgatttttttagaacatcaaattcttatttccaggttgtgcagatctttgtcaggtattaaatgtggatacaggaaaaaaaaaagccccacagacaatttttttttttttttttgaaacggagtcttgcactgttgcctgggctggagtgcaatggtgcaatctcggctcactgcaacctctgcctcccgggttcaagtgattcttctgcctcagcctcttgagtagctgggattacaggtgccagccagcacgcctggctaattttttgtatttcttggtagaggtggggtttcactatgttggccaggctggtcttgaactcctgatctcgtgatctgcccacctcgacctcccaaagtgctgggattacaggcatgagccacctcgcccggcccctcacagacaattttttagtgatgagtgaaggttataataataaaatagtcaagagactccagctttcagagcaactgactcaaagactgtatttatagttcaaattgttatatgattgtcaacaagtctggctggtaacagttgggttagttttgataaagagcagaagttcctgtctttaatgacaaaaatagtatgttgcttatctcaggatgcaaagcttttaagatgggtctgtggttcaagggcttcaagtatgtgagacttttagaaatacaaatctttttcaggctgtgggatatgaagtcgccaacagagatgggcaaaaagcacaatgccatttgctagttttcagtatctaaataaatattttaaatatagttttctcagtagcaacatggaattcccatttagagagaaagtttcagctgattgaatcgatatgacaaaagtttggggctgtcaactccttaccctcttccaccctttgttccaaatagtagaaagtagcaataaggaaatgaatggggcagaaattaaacttcaaaaatgacagcaagtgcccactgtatttcctgggctaagctgagttggagaatgcagctggaacttcaggttgggtgggggcttcctactgcctctctagatctagacctttgggtccacctgtatacacttatccagcatttcttgattctaggcctgatgtagccggagaaggagagtctgataggtgctgccttttccacgtggtggttttacctgatcccaaaagtatagcctgatgaatttcaatctcaactttggcctagatgcctctgcttacctggagcctggtacacctgtgctgaagaaacttggaatttttcttccggtagtccttgctactggggtagaatgtgcacttttctactttataatcccctctatgtcaaaattattattttattaaatttaagaataacatccatagcaggaatattataaatgcattgaatgaaaattaatttgcatgcagttacaaattacaaactagaggttctttgctataagggaatactccatggcagagccctcatgcagtaggtttaattcaatctatgttctcaggagtgagttggcccctaaggggatactcacctgtatctattgttctgacctagttgtatttctgcattgatatgctacaaaaagggatctctttggagcaaggagaataccgagcctgaaatgcctgggtgagagaattggagaaggtttagagagcttcacactcagggaaaaaaaaaaaaaaaaaaaaaaaaaaaagagaaaagaagaaaaaagcagagtgtgaaagtccaagggcttctgtgcatgttattagaaatgtgcatgtagcttggagtcttgaggctggacctagacatctctctgccttgcagatgctcttcctgagtttgctaccatcctttttctttctgctttgctgtggtgacattcagacatcagacaataaatggggtctgtgcacattaggggcagtgggtgggtgaaggctggaggaggctgtgtctcttctggtagagcagtcagcggaaacctaagtgaagaaaggaaagaagtctgtacccttgagccctgtcacacgttagaaaatggagacgggcttgagctgagcactccttgtcagaccccttcaggtgttactcacacaatgcaggggttcagttgcttggtgggtatcaacccaatgaccacaaccaaggaggatttaacaatgagatttaagtaaggagaacaccagggatggttcccaaagtagtgcctctgagctggggacgggttaggttttataaacgtcatgtaatgtggatctgattgactgggtcctgccatgggtgatgccagagctcaatccagttggatcctggatcctgccatgcaatgtccgcttcttaattcaatccctgctcctcagtccgagcactccagctccccctgtggttgcacactagttcatccaggcatgcccgggttatgtgacctgagggtccatggcaactgaaaaactactcacaactttgttacgtaaaagtcgaaccagattggcctggtgcggctaacatagacagcagacaccactccacctgctcagtccgtcaaccttcacatgcggaatctcactcctcacctccggcttctgagcccggcattgacacagactcagccacgcccatccccacgtcactcagctcccggcactttccctgggctcctcttgcatccttgaccgactgtctccaattccacacctggctcctctatgtggcagaaggacccaggctgtctccagaccctttctgttctcagtctgtgctcacatgctagggaatcttatgcagattcatttgcaacctaaaaatcccaattacttcctgacaacttccaaatttccttctccagccaacacctcccctgaccttcatgctcatgtgttcagctgcattcccactcagatgtcaagcaggcccctcaactttactcatctgaaaaaaaacctcttcatctttccatgtaatttttcccacccctggtgttctttccctcagatgccagggacaacaaccttggcatgcttgtttagtctttgttcttcttatttttttcagttagaaaactctcccttctaccttccaaatgtttccctgatctggccatgttctaccacctccaccagcacctttcagatatgagccagctctcccttccttctccccttgcctcgatccctaatgcggtagccagagtgacccttccaaaacatcatcagatggtgttactcctttgctgagagtgtccagcgtcttccagtcttatttggaataggtgtccgatttctaagggaggccactgctaggtcctgctgtctgggtggcatatctctccttctgccctccccggcactctcttctccacctcgctggctcctttgcacccacctcagggcctttgcacttgctgctcccgcacctgcagtgtgcttccctaatgatgataaggagggttgtacaccttcctcttgcacctccagcactgcccccacccctgccttattttcctccaggtcacctgtgacatgctgaccagtttgcccctacagctgtctgctggtagtgttcctgcactgggttgtgaacctcatggaggtaggagttttgtctcctgtgttcatagctctcagtccggcacctagcctgggcctggcacttggcaggtgctccataagtattttttgaatgaatgaatgaacagtcctataggatttctgttcaagttccactcccaaatcacttgggaagaaaagaaacttataaaatgaatgacaataatagatgaattagagtcaagaagttgcatgctttgtaataatctattggctggtttagttccccccacagtgagattttgtggtttggttgaggcggtggtgacagtggcatgagtgctctgatcatggattaacgttcatcatttcctgagaagtcttcagccccccccccgccacacacacactaaatctacctcagctctgctggggggctccatcttggggcggcctccagagcttagctcccaaccttgacttttcagcagtcttcacatttccttggaacatatatttgtgagcttcctctggccacttgaatgattcatgattttcctttgcaagagaaattgacagtggttttgaaaaaaatattcaaagttttacttcgacagaaatattatctaagtgttgacctacatatgataccttcccataattggtgcaacctggaactatgcttccaatatcagtaagaatatgttgatataaataaaatgtgatgaagcaaataaattctgatgatgtaaaataaagtatttatggtagaatagctgtgactagggaaagtgtatagattcatgtgtatgtttatagacatagatgttatatgtttgtggtgttttctgggttattttaaatattatgttacctatatttgtcatttaattccacatatggtgttttgcattttgtcaattaataggtattattctaaaaggtttttttttggcaaaatgattggttgtttaaaaaactgattgtttctaggaagatacggataagatgtccatgaaatcttagaggtgggggttagagatgtggagagtggggacctacttctggagtctttccagatgttccccagagtcttaggagcctctccacctgcagtggacagaacaggagcctctcaggctgtactgctgaccttcagagcacggcaaatcccggttttatccacctcacataggaatagccacatatgatttctttctaatcattgtgtttgtggctgtgaattttgaaaagcctcaagtttctttaatttttttttcattttcatatttattttttaataatatatatttgaagtgtacaacatgatgttttgataaacatacaaagtgaaatgattactacaaacaaatgagcatatctgtcatctcagagttatctttgtgtgtcgtgcgtgtgtgttaacagtacctaaaatctactttcttagcagatttccagtatgtaatacaatattggcaactataattctcatgctgtatattaattctctagatgtgttcattctacataactgcaactttataccccttgaccaacatcttcattcctcccaagttcatccctggtaaccaccaccctatgctttgtttctatgggttttttttttttttttgttttgttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccgtttctatgggtttgacttttaaaaagtttgactctacatgtaaatgagatcctgtaatagttttctttttgtggctgacttacatcacttagcatatcttctgggttcatccatgttgctgccagtggcataatttccttctttttacagctgaataatattttattgtatataatgtcacattttctctattcattcatctctttagaaacattttggctgattctatatcttggcttttgtgaataatgtaaatatctctttgggacataatttcatttcctttggctttatacccagaagtgggatttctggatcatatggtagttccatttttaatattttgaggaatcttcatactgttttccataatggctgtaccaatttgcatttccaccaacagggcacaaggtttccctatcctgcacacccttaccaacactcgttatttcttgtctttttgataacagccatcctaacaggtatgaggtaatagctcattgtggttgatttgcattttcctgatgattagtgaaattgagcaccttttcttttacctgtttgccattttgatgtcttctttggataagtgtctgttcaggttctttgaccattttttaaattgagttatttgtttttctgctattgaattgtgtgtgttcctaggaacagagcttcaggaagttaagagccaggcgatttggtggagaattgcgtgttctctgctgtgtgttcaagaacaagctgtcttgcttggctggctaacagcggagccaggagtaaaatctgggcttctgtatttccacagccaagggctctttctactactctgcaatgcacagaagcaactgacatgattgttctctgtgtttcctgagactaatgagaataaatcaaaatcttacagataagtatgtgtgcttctaacctatatcattgctatgttttctaggaaattgaaaagatatggtcctcgccgaatcagctaaattgtgaaagtcttagcaagaatctttctagcaccttggagagcttcaagagcagcttggaaaatgccactggccaggactgcacaagccagccgaggctggagacggtgcagcagcacttgtacatgtatgctctgatattctttcatgccctccccagtacttccattcatagagaggatgtctaggactctttaaaatgtgaatttcagacagtggtctgtataatatactcttaatgtgcatattaatatatattttccaaacatcaaagttttccatgacaatttttgagtggtaaaatgtaacagcagcattaatcagaaggctaactttattggcgataaagatattagatataagaatgtaatccacaacgcttggtggcaaatgcctgtaatcccctctaatgggaggctgatgtgggagaatcgcttgaggctaggaatttgagaccaacctgggcaacatagcaagaccctgtctctaaaaaataaaagcaacaacaaaaaaattagcaggatttggtgctgtgcatttatggtcccaaccacataggaggctgaggcaggagggttgcttgaccccaggagttcaaggctgcagtgagcagtgattgtgctactgcactccagcctggctgacagataaagggcctgtctcataaattaaataaataaatgaataaatttctgtttgaacagcaaatatttttcttttcttttctctttttttttttttgagatggagtctcgctctgttgcccaggctggagtgcagtggcgcgatctcggctcactgcaagctccacctcccgggttcacgccattctccctcctcagcctcctgagtagctgggactacaggcacccgccaccatgcccggctaattttgtttttttattttaatagagatggggtttcaccgtgttagccaggatggtctccatctcctgacctcatgatccgcccccttcggcctcccaaagtgctgggattacaggctgagccaccgcacccggtcgcaaatatttttcaaattaccttcatgtttgatcaattttgcttagtgttctgaaagtgtaaagcaccagaaggggaaataaggaactttaaattctgcaagtgactttttcactgaaagaatgatgttcatctgaccctggctatcctaatttctcgtacgttccatgatctatcctatctattctcttcacagttgtgaaaagccatttattatgcatcctcattcccctggttcatctcggttggcaggagctctgagaaagaaatactggagtgtgggtagtattaatggatattcacatacagatggtattgggagacatgtgggtctaattgttgcaggaactttatggaaatgtgatcttgttatccagtccatctcttgggagctgaggcagtattattcattccaacactgtttctgatgttttagcttgcctaatttagctttaattttctgccattttaggttggccaaaagcctcgaggaaacttggtcatcagggaatcccatcatgacttttctcagcaatttcacagtaactgagggtaagtatgtggttttccaagtttgcttgattaaaaattaaatttagtttctcatgcaaatatattattaaaataaaacatacaacagaaaatttatgctatatgtgatacataatcatttacaacttggctggtatgatgtatttggcatttataaagaaagtcctgaaatcctagggtaccatgttgaagcagaggaacaaagagaagcttctgtggtctggattttgctctggccttgcctcctcggacaagcaattgatgtctgtgtgtctctgtttccttggctgttcactctgtcaactcatgaagcttcttgtagcattaacatgccatgtctgaagaattctggcaaatacttaaatgatccctctcttcttaaaaaagtgagatgagtagatgcatgtatacaagtgagtttcttatagcacttggtcactgctccctaagaagaagctctttctttctttctttctttttttttttttgtgtctcactctgtcacccagctggagtacagtggcgtgatctcggctcactgcaacctccgcctcctgggttcaagcgattctcctgcctcagcctcctgagtagctgggattacagggatgtgccaccatgcccggctatttttttttttttttttgtatttttagtagagacagggtttcaccatgttggtcaggctggtctcgaactcctgacctttgatctgcccacctcggcctcccaaagtgctgggattacaggtgtgagccaccacacccagccagaagaaactctttctaaagtaaatgttcttaaaacatacaggccttagagagagtagaccagtaaccagaaaataccacagaacctggcattttggtttattgtcatataaattatttaagttattcccaggggagtaaggtatgactttatttagtgatttatgggttgaatggtgtgaaagaaactatcctagccaggttgtaatatcaaattttgttttcgcagtcagtaatgatctaaacctttattacacaaatttcttattttccttactttgcagatgtaaaaataaaagatttgatgaagaatatcaccaagttgactgaggagcttcgctcttccatccaaatctcgaatgagactatccatagcattctagaagcaaatatttcccactccaaggtgtggtgctgtttcttgtctgtctgttttgctcatggaaggagccttagcctgaagtcactggcactgtgttgtcctttcttccttcttgccttcctctcctttggctagtgtagtgggttgctgcacaaatgatataattggaggcagaaaggaaacaagagaacaagcaaggaaccaaagggtgtcattgtcccatgccaaaatcttagggtttttaattccataatattttctttatttggagttagaacaaagttggtgattatttattctgttgatttccagccctgatgcatgacacctgggaagggtctcggcttgattcagcaggtgttgcaaaattcttaaaatacccaaaaccaaaaacagctaaaaatatcttaagaatcaactatgacttcctctgagtggagagtgactgggcacagtctgactatgtgctaccgtagtgaatcactgtgaacgcaaatgagtaatggcaggctgtgtcatctccaagctgaaaaatgtgataaaacaatcaaagagctactgcaacaaaccaagggatgagtaacacatacgggccacatggggtatggtttctctgtggaaaaggggaacggggacatctcatgttttccacagcagatatcacctggatccttagcaggagattttctgagacagctttcagcacttctagttggggttttatcttcctgtacagagaaccttccagaagtagtaaccgtggagctgactcgtaagtgaacgttgcaattgaccatcaactgggccccaacacacgtttaatatcatgtcaattctggttaattggggcttattgcaagcttgacgggtggactaatgaagaattaatctaaattaaaaagagattagaagctgggaaaccaaaattcaaatgacagtgtcaccaagttacttataataaggcacttagtatttatcttcaaggaaaaatgtcaaattcagcttattaaacatgcaagagccaaggaaagcagggggcagtgctgaaattgtctcttccctacctcgcatgatgccttatagagaaacaatgaagatttttggtttaaaatctttagttattgaaacgagtaataggggaaagaagcagtggaaggagtaatcggagcagctacctgggaatgttttaagaccagggtcagattagctaacttctggggtccctttcaaattcagttttatgatactttttgggtttgggctcaactgtttttgatgaccactgcctgatgaaacaagtggccactgggtgtcactgctgttctattatgggagggctgtgcacagagaaggctcctgtggtaatgtggtattgtcttgtgtagatggttctgtagtgctttttttgcactctgtgtatctttctctacctctttgtcagtatgaatcattatgatcgcctaaacagctggacagttaagtaattgggaggagtatttaaaaagttgcattcttgcgtttcaaataagtaatgagattatttgctttgatggttaagtatatccataaatgcacatgtatctacagatcctaggcaaggaattaacattaggttaggaggtgacactttggatacttgttttttctagattgtcaggtttttagcagcaccatattatttctagtatccttttcttatctttcttcctgggtttctctaccatagctttagtcagtttgcaaataatcacatcagattcttagtccaggctgttggtggcatgcagggaatactcttcagtggtgctaaagccctggcaaaattgcagaaatcttcattcattcatttcttcctttattcacttaggaggtttctgcatgacaggcatggtcccaaaaacttgggctcaaagcccgtgctccaagggagccaatgttctgtgggggatgacacagtaaatatgcaaacaaaagaaggtcagtgttaagagaccagaaagttctatcatgcaaatagaacacaacaatgaggacaggtggtccctggaagcctccctgaatcggtgaagatggatgtcagactggaatgatgatctgcatatgaagagctatatgagagtcacagagctggggcatttctgtcaaaagaccagagacaggagtgagcagaaggaggcaaatgcagcagatgcatggataccatctcatttttctttcctgccctcttccctggctgcagagaacctgccatgggcacccacccatgggaatttcctttttcttgcagagctctattctctaatatcagcatcacccaattaaaaccacaaatcacaggggcttcctggacactggagcccatctagcccagccttctgtcctgggtttgcatcctgtccacctgccctgtgaagcacccatccacttcatgctgtgttcctatgttttaggcacatgttcaaatcaacaatgacttccttctttgtgttgggccaaatttttattcttttaaaattagcaatgaggccaaagtgtcaggacccaaatagattgagagagcaatcaaaagtcggccctctgtccctttattttctgtggtaaacaattaggcagagttcagaggacttttgcttggaagatgaatattttttcacagtcctcagtggattcattctccccgcgccacaaatcttaaggaggaagggagagggcattccctgaaagttccaatctcttctgggaggctccttcaaatggaaaggtattctgaattttttttctttctgtttcttttgagcagaaatgattgagtttggtgaatctggtcaaatttccttatctcacttggggccggtcctgggggctggttctgtcggttgcgacattaacagagctgctgggcataatttatggagagggagagattccttttaggagtttggaaacattacacattccacttgttttaatacatgaagtttgtttcctggaaagctccaacagatagttcttggtgaaactcatttcagagcagacactggtcaaaatttgctcattcttttttttttttctttctctgaagacaaaaagtaattaatgtgtgactagagttatgggtttctgggatcatgagaagtttggcctgaagtttcctggaagacaccatctgtcatgtgcagagtctcattctagagaaagtccttcctaggccttagactgcttgtctggctctgtcaccacatcaggagattggggtttgtggtccttgtaatccaggattcacagaatgaagtgcacacacccatccaccaccatctcattctctggtgttcttagagtagggcttttctctttgatttgtttgatttgttgtcctaccagagtattctcagtaaatgtggtaggttctcattaaacattcactaaaataaagtgaaattccagctactctccttccattaagtcagctagcgtttcttaggtttatgaaagccacgttaccttatttgctcattaggaattctgagaaatgagtattgtgctaagggcatttgtgtctcatttaactccctctgagcagggcatttctcttctttcacagatgaatgtgatgctgtggaagtcacagctgggagagggcctgaaatcaaacccacgtctttgaacttgaactgtgttattcttccatcacatgatgttattgcttcaatttgttacaaattaatagttctaagaaaattactgcttgccgatgggtttcctcttctcctacttgcacttatgtaaatatttttaaaccttaattccccaattggcattgatctctgcaaaaatgcttcttgctaattttggcaaaatattttttcctttttatttttaaaaattaaacttttattttaggcttaggggtgcatatgctggtttgttatataggtaaactcgtgtcagggggtttgtagtacagattatttcatcacccaggtattaagcctagtatccaatagttattttttctgattctctccctccttccaacctccaccctcaaataggccccagtgtgctttgttcccctctttgtagccatgtgttctcattatttagctccaacttatatgtgagaatttgcagtatttcattttctgttcctgtgttcatttgctgacgataatggcctccagctccatccatgtccctccaaaggacatgaccttgttctttttatggctgcatagtattccatggtgtatatgtaccatattttctttgtccagtttgcccttgatgggcatttaggttggtttcatgtccttgctattgtgaatagtgctgcaatgaacatacatgtgtaggtatcctcatggtagaatgatttatattcctttgggtatacagccagtaatgggtcaaatggtagttctctttctagttctgtgaggaatcgccacactggtttccacaatggttgaactaatttacattctcaccaggagtgtataaatgttcccttttctctgcaacctcatcagaatcggttacttttttgactttttagtaataatcattctaattggtgtgagatggcatctcattgtggttttgatttgcatgtctctaatgatcagtaatattgagatttttttcatatgcttgttggctgcatgtatgttttcttctgaaaagtgtctgttcatgtcctttgcccactttttaatgaggttgtttgtttttttcttgtaaattttttttaagttctttatagatactggatattagacctttgtcagatgcatattttgcaaaacctcccgttctgtagattgtctgtatactctgttgatagtttcttttgctgtgcgtaagctttttagtttaattaggtcccatttttcaatttttgcttttcttgagtttgcttctggcatcttcatcatgaagtctttgcccattcctatgtccagaatagtattacctaggttgtcttccagggtttttatagttttgggttttacatttaaatctttaacccatcttgagttgatttttgtatagcataaggaagaagcccagtttcaatcttctgcacatggctagccagttatctcagcaccatttattgaatagggaatctttccctattgcttgtttttgtcaggtttgtcgaagatcagatagttataggtttacggccttatttctggactctattttctattagttccataggtctatgtgtctgtttttgtgccagtaccatgctgttttggttaattggatattctttcaaggtgttttttgatatcaaattctgatactttaatttgcaaagtatcatttttttctctcaacttcatcagtcaccaaaagatgagagtatcttttatattttcatccaagtcgttagtgcagaaagattaccatggcataggaaggtataacctaacacctatttatttgtttgggctcttaaatcagttgcaacatgtctgtctggggtgtcttggtaatttattagcctaataatttcatcattaaaagaaaatgactttatattgacatggctcattgatcatgactgtatcgacatggtttccagcaattttctttttcttcaagggcttacacataatcttttggataatccatgattagaattcttcaagaattgacattattatctattagtaatttctaaagtctactttacaaaataaaacctggatagtttttatttccatcacgacttcttaaaaactgtagatagtagaactgtcactctttctgaaggcatgaagagggaacagggagagagggaactggaaatggagacagagaagttggtggagaaggtggccagacagcagccatggcctcactgaagaactacagccaggctgaatggtagttctctttaggttctttgagaaatccccacactgctttctgcagtggctgaactaatttacattcccaccaacagtgtataaatgttccctttttctacaatctcacaaacatcttttattttttgactttttaataatagcctttctgactggtgtgagatagaatctccttgtggttttgacttgcatttctctaatgatcagcgatggaacaatagacatgggggactactagagggggactaccagatggggaggatgagagggggaaaaagagttgaaaaaccacctattgggcactatgctcactacctgggtgatgtgatggttcatacaccaaacctcagcaacacacaatttacccaggcaacaaacctgcatgtactccgtaaacctaaaataaaatttgagaaaaaaaggaactgcagccaaatgatgcctgccttactgggcaaggacaccattggcactgccctagaggccagctgccaagatgcttatccacagatctcctaggcatcctgttttacccttccagtgtgaagatgtttctctttaggaatatgaaaaccaagaaggaattaattagttctcttaagtgtaatcatcatccttaatcaataaacccacctaattcttattcatcttttcccttaaatatcctgtaagtcaaaactgtgcttttgctggcagtgactgataggcttcttagtagtaacgtcatttttgagcacttatatacactacccctgagctgaatgctttacatctcatttaattctcccaacaaccctttggagccctttgtcttttattgtcatccctggttgtatagacaaagaaactgaagtgtgtagatgttaagcagctttcaggaagtcagacggtaagagctggagtcaggatccaccaccttgccacagtgtggcttcagtccttctggccaggttctcgcagccttctcctgccctccgatgctcatctcttgtacttgcctctttatcctgtgagcagctctgagctcaaatgggtccccaatggcagagagccacactgctcctctctgaagggcgtagggcctatttttaaatacctgcgctcctttcattgtcttgtcttacaaattctaacttggcagactctctctccccatcatctccagttcccttgaatcactgtccgtgtttcccttccggtcacaactgagctgagggcagcctttcctcccatgctttcccaacctctgagtctacaatgagcagctgggcaacatggaggccatctctggtgctctcctctgaatgcgattcgggtttcagcagatgtccaataaacaaagctcttgctaaaaatgcaaatgcctctcctaaggatcattgtcatttttaaaccacataaatactcagataattatctaagtggccaagtgtgtatgagccaggctcgcagggcagagaggcatcgccctggatcctaagcccccttacagctttccaaaccaaacactgacacacaggaaaatcagcaggaacttggcattctgtttctgataatttgcagcattagcctatgcaaagcccgagataaaaggtgcctgttttactttgaatagaaatcacacaagatatttccaatcaagcacaactcagtgttgtctttgcttttctaatcttcctcccctcctacctactctcaaacaggaacaacgaacgaacgcaatacaatctttaaaagataaatagtaatatttggaaaaccacaggaaaggagagggagcaaatgtgctgctggggctgtggcttctgtgcattgtgactgcggagcttccacatgacagggtgtgggatcctctctatttggtaaaaagagatgtaaaaaatttcaggacaaatattttttgtcctgggactagactctaaaaaacgtattaaatatgatcttgcatggggaccactgtgtgacatgctagaaagtaattaatacaaatgttctatgacaaatgcagaaaggactctcattgggccagcttgggttgatgctcatgaaaagccagggtgattcccctgaattgggggtttggatgaggtccattttgagggatagtttcatgcaaaagcctattttgtgggactgatcaaagagaggctcctcttgtgaaagcaaagggtagatgcctatattctgctcccaacctcctcctgagagcttcccctctgcccagagacagcatgattgaaaacagtggcattaaggaaaacttcaccaatgtgtgtctgcacaatgccagccctatatgaaaaaaggtctttttggtaagttagtgatgaaaatacttaatatcctttcttaaagactcaaaatgcacactagcatactagagtatcatagccattggtgatgattaattttgtgtgtcaacttggttaggctgcagtactcagatatttgttcaaacattattctaaatgtccctatgcgggtattttttagatgacattaacagttaaatcagtagactttgagtaaagaagattactcgtcataatgtgagtcagccttatccaatcagttgaaggcaaaaaaagtaagaaagtcccccaaggaagagtaagttccatctccaggtagtccgcagatgtgagctgcaatgtcagctccttcctaggtcccaaatccgctggcccaccctgcagattttgggcttgccagcccccacatttgcatgagccaattccttaaaataaatctctctcaatgtatgtatgctatgtgtcacttaatgactaggattcattctgagaaatgcatcattaggtgatatcatcattatgtgaacattatagtgtatacttacacaaacctagctggtacagcctgttacacacctaggctatatggtatggcctgttgctcctaggctacaaacctgtacagcaggttactctactgaatactgtgggcaattgtaacatcgtggtaagtatttctatatcaaaacatagaaaacacaagaacgtattttactatacctgttctaaacatagaaaaggtactgaaaaatatggtataaaagataaataaaatggtatgcctgtatggggcacttggcatgaataaagctacaggactgaagttgctctgggtgagtcagtgagtgagtggcaagcggatgtgcaggcctaggacatgcctgtacaccactgtagactcaataaacattgtgtgtttctacatttataaaaaaaaatttctttcttcaatcatagattaaccttagcttactgtaactttttttactttataaactttatttatttatttatttttttaagacagagtcttgctctgttgcccaggctggagtgcagtggcacaatctcggctcactgtgagctccacctccttggttcaagcaattcccctgcctcagtctcccaagcagctgggattacaggtgtacgccaccatacccaactaattttttttgtattttaagtagagacagggtttcaccatgttgaccagactggtctcaaactcctgacctcaggcaatccgcctgccttagcctcccaaagtactgggattataggtgtgagcaactgcaccctgccgaacctttaaaattttaaaaaacttttggactcttcagtgataacatttatattaaaacacaaatacattgcacagctgtacaattgttttcctttgtgtccttattctataagcttttttctattttaagtttttttacttttaacttttaaaatcgtatttttaaaaattaagacacaaacacacagtctagtctaggcctacatgaggtcaggatcatgaataccactgtcttccacttccacagcttgtcccactgggcggtcttcaggggcaataacatgcgtagagctgtcgtctcctgtgataacaatgccttcttctggatacctcctgagggacttgcctgtggctgttttacagttaaattttttttaataactagaaagagtatactctaaaataatgataatatagtatagttagtacataaaccagtaatatagtcatttattatccttgtcactattatgtactgtacataattgtgtgtgtgatacttttgctatgaatgggagtgcagcagttttgtttacaccggcactgccacaaacacttgaataatacgccaggctacaacactacaatggctgatgtcactagaagataggaattttttcatctccattataatcatatttttcatctccattataatcttatgggactaccaccgtatatgtggtttgtcatcatgtaccagatagcgatattttggtcaacaatggaccccatataggatggtggtcccatgagattatactactgtatttttactgtacctttttactgtaccttttctatgtttagatatgttcagccacacaaatacttaccactgtgtgacaactgcctacaggattcagtacagtgacacgctgtacaggtttgtagtctaggagcaatagaccataccctatagccaaggtatgtaggaggctgtatcatctaggatgctgtaagtgcacactatgatgttcacacaattaaacaattacccaatggtgcatttcccaaatgtatccttgtcattatgagacacatgactgcacacacacacacacacacacacacacacacattctcttggttctgtttctctggaggaccctgactactacaccattatttatatcttactgtattttgggaacattttatggcatctgttgagttctccgtgctcttcttcagagagcatggttcctattcacataggttcatgcacttcggcctcagttggcctgaatgtttcacagcaatcatacccatcaggagcaaaaacatggagcaggaagtatggtttttgttttattttgctttgtaatttggcatatcacaaatgtccttaactgaaaagcatacccaaatgaagaggtgtgtcaaagcctttaattgcgatgcatgatagtaataaactagagactaatataagttgtcctcagtgcctccttctgagtgtacttgctttaaaaaaatatataacaagcttggtaatcctgttttcaatctaaaaatgaaggagcaaaaaatatcagcttcacactgatgacggtgaaaagtggaagctgataaactgaaagccaagggtaagacttaatatcagacaaacgagacacagatgctaactacgggggtggcatcggagggtgggggcttggtgggcattcagagtgagcctcgtggagagcagagggacagagtttcagaagggtgatccaaagacctcaagcgagggcaaattttataagaagtcagagaatgatgtgcgcacttcagaaacatttccatcaaaatgttgagaatcgaaccccagtttgggctccccgcatctgcaggtcagtcccgggagttgggaaatccactcttgggcgactccctgccgatgaagctccggtctgaggtggtgaagcacatgacgtcataggtatactcacctctaatctctgtgctttgaaacaggttctcttcagtgccctcaccgtagctctgtctggaaagtgtgatcaggaaatccttcatctcctgctgacatttcccaaaggggaaaaatcttggatcgcagcggaggaactctgtagcctgccagggtcaaaagtgtattctctgattgtgttgctgagtcgaaacttggatgtgcgagctttcatttacaaggtatggagagcatgctggctgggggcagtcctctgcaggactctgctgtggtggctgcagataagtacagtagtcctaggggtgcggcagtgggagatcagcacctggccactctgcagtggtctccaccagcctctggtgtcacctgtttgctgaatccaaggtggggctcaagaagactttgttgtaataaagggatgttcaggagacccttcagggggtccttggaaataagtgtcagggcattgggacagagttggtggtgatctccatgctcattgtggaaggacccactgcaaaaacacagcaccgcttcctaatgccaggtgttctctcctctgtaagggccacctccctggagcatgtttgaggaggctgggattgtgcatggtccactcctgagcggcccgagttaggtgctgctccctgcacggtggccctatctgtcagcgggaagcatccagctctgccagggcctgccctggagagaatgtggaggggtgggcagcacaggaagcccaatcccctgtgtgtgccggctctgacaagcatgatcctctgacaagcagcagtgtgagggcagggagggactggaggaagctaaagatgatgaagtctgcaggagagagtggagagtgggaagtgaggaggagctggggcaagcccaggcccagcactttccggacgggcccagaacccatgtaggggcaacctagctccaaaccacagctcactgctctcaagctgccccttccagaagcttctcctccttctggcctctactgtttgaatctttacttaagtttccagaagcttcccctccttctggcctctactgtttgaatctttacttaagtttccagaagcttcccctcttacccttaggcactgatcttgctccaagtaccattgttttccctttagggaagtatttcacaacctctgggttcattagagaggctgcagggtttgtactatggtaaggtggctgtaggcaccctgagtttgggtgaacagttttatagtcagcaaagggtagatttgccatttcagccacgcatgatttccttagtttctattacttcaagagtccagggagtaaatgttggaatgaacacacacacacccacacacacacactccaagaacaaatatttgttttcagaatgattacattttaaacccataaggaggagaataaacatttcttgcatccccataatttgcaaacccacctctatcttggtggaattcgtatttttcgctaacatgcttatggtttagctctgcatttgctcaccacagcctctcttccaactttacagtttgccttttgggaaacagagctcccattggcacgatgctactttagtggccactttgttatgtgcacaaaggtccccgatttgaagtaagtgcttgtagaggcccacataattactgtgacaagggccatcatctgtaccaagatttctttgaaggataagatagtgggttggattcagtctcccagacacaatgaaaatgacatcatcattaataacaacagctcttatttatcaggtaccttctatatgaagggctctatgaaagttgattaaatacaagatatggctcaggatgttagggcagcccgacctccatgtgagggccacgtgcaggtgcagctcattcccaagtccatgtactttctgattcactcagctgacaatgaatttctgaagccttcagcaaagcacagtttgctatattaattcggcacatcaatctggtctcttggagctgcgctggatccctgtcactccccaccataagtcaggggccagtcactgtgtgccacttttttttaaagggcagctgcaattagaaagatgagtagaagaagtgacaaaagctacacaccatttctcctgctagagttgtctctatagtatgaatggacagaattctgtcattataagcagagtgcctctgtgaaggatggagctgtgatcccggagccctgaaagtcatctgcagagctaacagctaaaacactaatgagcaaaaataagaagcagtgacaactgggttcctctgccccagcctggaaaacagaaaattcaatatccaaatgacagacagtggaaattagctgtgattttccctgctctgtgcgaagagctggcatttcctcatttatccattcatccaacaaatatttattgagcaactaatatttcctgttgctattttatgcccagtagctacatgaaagatcaagacagaagaaaagccttgcctccagtgtagaactgagaatatgaaaaaaaaaaatcatgtaaaatacagagcatttcagttggtgatagcataagtaagcttcagagggcactgacatttttaaagaatccaggttaaattcacatccctgaacctttctaactgttagacttcaggaagacttttaatctcctcaagccccagttttctcatccacaaaacgaacagtataatgcacatccccaaggtattaggaggattgagatgatgtgtgaatgctatgaatactgtaaagcagtagataaatgtaaattgcttcacatataaggactgctcatattttgagcctcttctcaaatttccaccttggtcacctcaaagatacaaagaaatatttggcaaatgatttgaattttaatgatagatcacatttgtttctggtttacattttaacaatgctagtgcaattcagtgtgctccaaaacacatgagctatatatactctaatgaagataactttcatatagtaccgcaaaggcgtctctgaagttcaagagagaataaaatcagataaacaagttttcacagctcaaaagatgcttctgagtgtaaaaatacagtgttggttatttcatgttgttttgtttttgttttgtcctttagactctgatgccttctgaagcaaatggcttgctcaactccttgctggatatagtttccagcctcagcgccttgcttgccaaagcccagcacgtctttgagtatcttcctgagtttcttcacacatttaaaatcactgccttgctagaaaccctggactttcaacaggtgtgtgtttcatctttgtccctagggaaatattcaaatttgccccttctttgtatttgcccctttttgcctttatcttcccacatctaaaatttgcattagacagcaaaatacaggaatgaaagtaccttttcatatctctggaagcaacagcataacatagaataaggcctggcatctctctaaaaactgcatgaaactgatattgttgatctacattccaccagtgtggagattgggatagtacatgcattatctataaagtaagaaattactaactcagttattgcacagatgagatttcaagggcctgtttaacttaattcagagagcaaattgctttcaaaaaccttaaaacatatatttacttataaataattggcttacaagttacagatcatttactgcaaatgcaaacacaaacttgatttagtttagtgacttgatgttaggttttgtttgaactctttttgcctgggatggaactgactgggcacgaatgaggaggagtgtggaaattttagggttggacgtgtaggatgaggagcaagataacaatgttctcagaactgccttggagacagaatgtaagtccatcatgtgatagataatttgtatagctataaaatatctggatatcttggtagcatagacatacattaagactagtaattagtctgaattagtgatattttatggattaataatttattactggacaaatagtgtaaggacttatgtgtgtgtgtgtatgtgtgtgtgtgtgtgtgtgtgtaggtatgacatttccctcttctaccaggtatgttggccagaaaagttaccgtagtgtttcaaatggtatcccaaggacagaaaactctaaagcagacattccattcttttgacttgttgaatatcttgtacattcagtggaggaaggaactagactttcagaagtgtgtgaaggaattgttttaagtcactatgtaattgcaatttagttttcttattttctcaggtttcacaaaatgtccaggccagaagttcagcttttggttctttccagtttgtgatgaagatggtttgcaaggaccaagcatcattccttagcgattctaatatgtttattaatttgcccagagttaaggaactcttggaagatgacaaagaaaaattcaacattcctgaagattcaagtaagacagtagtaatatatatatatgtgtttagattcgtttgtatcttgataattggccttaaattatagtaagtattctgtctgtgtataaggttgctatatactggcatagaatcttctgcttccacctccccaaatgctggcatggcagctgactttgaacggttctagtgcctttgagcacagacaaatcctctcacctgagtcactaaggaactgtgtcaccaaggaaatgtctaaaacacctgaaaccccagccccattggtttcccaggctaaccagtattggtgagggtccaggcataaagaccatgagcactgctttggtccatgcaaatggctatattataataacgaagagaacttgtctgtggccacctccaaatttgctctctatgaagctcaggtacaagtgaatatgcatgataggtacaaacgaatatgtcacgatgggtacaaatgaatatgccacgataggtacaaatgaatatgtcacgataggtacaaatgaatatgtcatgataggtacaaatgaatgcaaattaatacataattttttggccccaatttaagtgaagatgtttttattagaaaggcagaataaacatgctggtgaggttttggagtttagacggttcagctccatcagttgtgcatttttggacacattgttttatgtgtctgcatcatgttggtttcatttataacgtagaaacagtagcacctggctcataagcttattgtgagatgcaatggatatgaggagtgttggtgccttagcataagggtataaatgtatcctagtgtattcgttttctatgctgcatgacaatcattgcacacttaatggcataagaaaacacacatttgtcatctcataatttctgtaggtcacatgtcgggatttctgagttaacatttttagttttgtacatatcgtgactatacttttttctgcaataaaattgctcctgttcatattaagcttgcaatgtaaagagtaggtcattaaatttcagtaagaacaacttctataattaatggcttaaaaatgtattatgtagtcatattcttttttttttttttgagacggagtcttgccctatcgcccaggctggagtgcagtggcttgatctcggctcaccacaagctccgcctcccaggttcacgccattctcctgcctcagcctcccgagtagctgggactacaggtgcctgccaccacgccggctatttttttgtatttttagtagagacggggtttcaccgtgttatccaggatggtctcgatctcctgacctcgtgatctgcctgcctcggcctcccaaagtgctgggattacaggcgtgagccactgtgcctggcctatgtagtcatattcttcatttatactttggggaaagtatttctatcaactttattgtcaaataatttttttcctttcaaatgggaagtttgggaagatgaaagtaacatttaaaacaaccacaacaatcataccttgagtatttataaatcatagtatcaaatctaagataatattttcattttattcttataaagctaaaataatattttcattttaaatgttctcttgatgagtaaagaaatagttatactgaagtattcctcactagcttaaaaccttataagatttagttcctactcattatggtgatgaaatctctaccctcatcaggtgaccattgatttagacaatttagttaagtaaatctttaattgaaatcaactagcatcacaagactcatgagagccaccaagagggattaagtacttgcgtgaaaataaggcaatttaatatgtcaaaattcgtaagtttgatggttctgcacgggctcattaaagacagttcagtagtaacttgtaaagctaacttcataaaaaaagctcagttccggtctcaatattgtgactgttgaaatgagaattttcttgatgaaaaaccagatttattttttgaattgtcattttcattttcaagtgtccatgtcattatttaatactctttttgattacttagtttgaaaatgtaagtcattctttcctgcctttgaagtcacttaagtgaacatagcatgaagtttcttatgagttgagagctgctgaaaactataacagggaaaaaaaatcttattttacttcctgtcttggtttatttggtgttgctataaaggaatatcagacactgggtaatttgtaaagaaagaggtttgtttggctcacagttctgcagactatacaagaagcatggcaccagcatctgcttctggtgaggcctcaggctgtttccactcatggcagaaattgaaggggagatgccatgtgcagagatcacaggacaagagaggaagcaagaggggggaggagggagatgccaggctgttttatttacttatttttaaacaagcagctctcttgggaactaatagagtgagaactacactcattactgtgacaatggcaccgaaacattcatgagggatctgcccccaagatctaaagacttcttgttaggctccacctccaacactggggatcaaatttcaacttgaggtttgggaggacagatattcaaactatagcactcccaaagttcagagtggtgtcagaaaaaaatatggctgtcattgaaaatgaggcatcctggatatgtgaatgaatttccctattaacctaggcatcgtgtatcattagcaactttttttttctttctaattgcaacagcaccgttttgcttgaagctttatcaggaaattctacaattgccaaatggtgctttggtgtggaccttcctaaaacccatattgcatggaaaaatactatacacaccaaacactccagaaattaacaaggtcattcaaaaggtaagttaaaataaatgagaatcatatagaccatacatacactaaatcaggaaggaatctttaaaaatgtctgacataattattatgcgccttggattatgtagaaggctcttgttttgaatctacttcattttagcctgagtgtttttcctgtcattgttattgttaaatctggatttgctgactccttcccttagaggacactttgggggttggggttgttatttagaataattaatgcagtgaacttacagaactctaatatgaaaagtcaaggacagtgagacagagaggaggactgtttggagtaattccaggaaaacttcgagaacaaatgctaatctgttttgcttggtgcatccaacaattacgaaagaatcagacatgatacatacaaactgatgtattagcagttagttagtattttggttagtgatgtttctgaattcactgtaaggctttgcttcaccctgtggagaataaggtgagatgaagacaccaaagcagggtgtatccaggaggaattgagacactatgtggctctgcttattttcctttccttacattgtttaacctctctaatctatttactgcaggatttgttattattaatatttgcactttctttttaaataattgtgttgtattttcctggagtcttttcttgcctactagggggcctgtaagcctacaggcacctggaaaggggacattttaccaaggacacaggaataatttggtcttattgtcaaacacagaagagaagatacctgcactattcatgataagcttccaagcctcaaatagcattaaaaatttggaaactgtgatcatatggcatgggatcatatgagcagttaagtcatttttgatcaaacttgccttcatgagtttcatgcttctgacccatggttgctgtgtgaggtcacagcactgtttcctgtaagttccctttcccactttgccacctacctcaggggctgcatttacctctgcctactctgaatggtatttaaactttaaaacatttatataatttatttaatttttgttttgttttgttttttggagagacagactctggctctgtcacccaggctggagtgcagtggtgcaatcatagctcactgcttggctgaagcagttctcctgcctcagtctcccgaagtgctgagattacaggtgtgtgcccccacgccctgctaactttttagtttttttttttttttgtagaggcatagtcttgtctacttcctaaaaaaaaatcttgaaagtgtcctttcagaggggtatttgccaaaagtctgcactctcacatggaacgacattgatctccgtatatcctcagtgtgagctgttctgttgggcaggaactctggcctcacagctgccatcccaggactggagcctctgcgccattactcgaatttccttagtgtagtaagctttttagggttttggatatttaaggaatttcacagaaaatggctccatatcacagctctattttaaattcaaaatttaaaaataggccatgactttaaaaaaagatgatatgctatattattatgttaatattattaatatatgactatagcattgcatattatgatgtattctgcagtataacaattagtgtgatgatctctgcttttaaagagctcaccctattgtggggaagagaaggcaaatagctgaagaaataagttagatatactatgctataaagaccattcagtgcagcagaggcacaggctgtggggggcagctggtctccctggaaagaaagattgggcaaagcacttggaaggatgggttttctaagcccctgtgaggtggagacgggaggattgtgggcctggacagaggtgtggggaggtgccaagccccacatgtgtgttctgagaatgatgagaatttttgaaaaatcaccaaagatttcactggtttttgcttagcccctttttagatattgcaggcagtattgagagctgatgtcttttttacttatttaaaatggctagcaactttgcatgcaggtatcctggttttgcacttgtaaagctgattttatggcattgtacctgggatgaattatcctagcagtcagccatggctatttggttttatgaaaattgtttctagtcattagactcatggtctaaagtcccacagagctgggagacgcttgtaggtttgcctcttgggctatgcgaagcaatattatctacagtgttggagtggcccatgctataaattatttaagacgtggtctttttctctccattacttcttgttaggtggaaccatctgaagttgccatttttgcaggaaaaaaaatctataaaagttggtaatttcatttggtttaacttgtaatagcacaggtgacacccagaagcatgatgctgtggtaagaaacgtgtgtatgtgtgttggaaggctggattttggtcccccttttcctaactctctgtgaccttgggcttattgcattctctttgaaggactcttctcctctatctgtgaaatgaaagacttgagtagatccgtgattttcagtcatctgggagacggctcttcatgggggatgcatcagaattacccacggacccttagtaaggccttccgcctctgggctctgatatccccatccctgaacacttgtacccctcacacccatccatatccttccacagagctgtgtgcacctccatctatcagccttaaagacagtggaggtcaagcattttcatgaactggaaaaaaaatgatggccaaaacttctagagagtgttaaaaggtaaacttagggacattaaaatttcaacaagtttatttgagcattcggttattcatgaattaggcaatgccagacaattcaaccctccactgactatgttgggatgtgggatgtggggtaatagaagaagcttgtatgaagtgtttgctgcagcaacagggagaaaatatattcgttaaagtcaaaagtccctagttggaggttagttggaggtttctgattggttaattttaacttttgttttactgtttgcattgatttgggttttggtttgcctacataggaactcaaggtgctatagctgtcttagcctaacagcctcctgatcaactattttaacaggagttaatttaactcatactctaagggtgtcagactcagtatttgcaaagaaattgatgctatttccatgtcattagtcaagagattccaatgtattagtatgctctttttattttataggtcagagtcgtgttcagttttggccctaggctgatgaaaaattgaagaacaatgtgtagacacaatgtgagcttgaagggaggctatgaaagaaaaacagaaaaaagaattatattgttttcccaagaataagtagcatgcctgaaatgatacttcagtgagaatcaccaggcacattctaggccactggtgcacaaagtaggtttagtctgggcttctaagggacgtataagcccatgaaaacagaccgtcttattttcatctagctctctccctttggctaaaggacagagctttgaactgtcacactcagtgtcctcctttgtgaaactgggctaaatcataactctcagtgccatttggaagtggaaaaaataccagaaataatattcagaaaatagtaaaccaatgggatctcctcccctacaagtgttattcccagaaatgcattctgccattgttgcctctggggagtggggaagacagatgtcacctcagaaagaggaaagagatggtggaggccagtggttcaaaccggggtggggttggagaaattttacccaactgggcacatgtgacagtatctgaagatatttttagtgtcacaagtaggaggcgctgctggcatctggaggctggaggccagggatgctgctatacatcctacaatgcacaggaaagcccccacccccaaacaaataatgatctggcttacaatgttagtggtgctgaggttgagaaaccccagcataaaggggtatataatgccagacgggagcgggtgggagcccctgggaagagaaggatgaaagtagaggaagctggtggtcaggtgggcatcctggcttctcctctactggtgatggtcccaaacaggggctgtgggatgatggaggagctgcaagctgagggccttggccctacccatgtgtcttgggggatagtccctgtgtaggccggccctgagctagcatgtggtcctagcagtgtggctgagcagaggaaggatacctgaattagtgtctctgagcatggagtagaagggagccagatttccctgacatccatgtcctgagccagtgtgtcaagtggaggccttggggacctgctatgagccggctgccgtgagagcgaggtggcctcagcaccaagctggcctaggccaggctggcagaggagatggctgaggctcagaaagcaggagccgaggtgagaaggaagcagcaagggagaaggcagtgccagaccccaaggttccaggtaagatgtgggctgggcaggccaggccctggcagcaccacagacaggcagacgaggcacatggctgtgggagtcctgggccctccacccctgactgtcaccaggctgcccctggagaacatcagggggtttgagcattcaccccaaagagcctgaatcactcagaggaagctgtttgaacagggagccactgtcagcaggcaattttgagactttgttctctcttcaccatccccagtgggtaaaaactggatcagctacaggaaatagagaactaccttttctttgcatccccaagcagtgaggtgtcagatatttggctttgtagcatcatctgtctgtatgcataacatcaatcaggaaacagagcaggtcccataaaatggcagccctacgttgggaacctggtgatcctctgtctggaagccgcctgcagaggagggactctgatagttatgtttgtttccaagtcttcccatgctgctcaagatggcaaagtttttcagtaaccttgtgtatcactccagacatggcagcagcccacacatacctggaatttaaatgccatacttccttgggatccagtgtgccagagacgcatgtcctcacctgaccactgtgttggagaggtccttcctcctttcaggctggcctcagcaggtggcagagatcagagagaggccaccagcggtgatccagacagccacgccatgtctctccctgttcccactctccctgtcctctcaatgcccagggcagccggtgctcctacctccagttccagctgtggggggctccagctgtctttctcttgcctttgttcctggagcttatcctccaaccttcttaagaagtatcttctctcctcaggcacccccaacaggcactgtgtgtttttgctttgtttttaaattaacatagagtaagttcggcaggctttttttcggtcgacagctctcacatttgtctggatcagtacacagaacagttccattgcccgagcccacaccaaatccctcattttgtcccttggtaatcacactgtcttcccaccctaaacccatctgttctctatcactataggtaggttttctttgtgagaatgccctataatggaatcatcatctgtaacctttgaaagtggtctcttttgctcagtacgagggctgtgattcacccaggtcattgtgtgtatcagcagttgcctcctctttattgccaagtggtattctgtggtgtggattcactgcagtttgttcgtccattcacccactaaagggcgtgtgggttttttctagtctttggcgattatcagtggagctcttaccttgcttttatcactacttgaaattatctcattgacttacaggcgtacttgtttattatttgtcgcctgctgtaatataagcttcatgaggggcaggagcttgtctgtcttcttggccaccgtccccagtgcctagaagaatgctaggaataccttcagcagtggctgttgaataagttaaagaataataattatttggctcttgtacccatttgagccaaagacattctggtgttaaatatacaagggagatagagtagactgtatgccaagccctctgcccgctgccagagccaggccttagctttgcagatatgcagtagctttgtctgagtttagcagtggtgggtgccatcaagaagattatctcccaaggtcattaatttcatttactgagcttgggccaggcaccttatgtggattatctcatgtatgcctcacaaccaccactgcaggtaggtactaatatccccattctatagctaggaaaaccaaggttgaaagaggataagttagcttgaccagggtcacacacctatcaagtggtggagctggaattcaggcccagtgtattattttgaagcctgtgatatggtttggctgtgcccccacccacatctcatcttgaattgccataatccccacgtgtcaagggcagggccaggtggagataactgaatcaccggggcagttttccccatactgttctcgtgagagtgaataagtctcatgagatctgaagattttataaatgggagttcccctgcacaagctctcttctctgctgccatgtaagacatgactttgatcctcatttatcttctgccaagattatgaggcctccctagccatatggaactgtgagtcaattaaacctctttcctttataaattacttcgtctcaggtatatctttattagcagcatgaaaacagactaatacagcctgtattagttttctcaggctgccataacacagtaccacagattgagtggcttaaacaacagaaatttattttctcaacattgtggaggctgaatgaccatgatcaaggtaatggcaggactggtttttcctggggcctctggcttgcagacagccatcttctctttgtgtcctcacatagttgtccctctgtgtgtgtgtcctaatatcctctttttataaggacatcagttatatggattagagtccaccccaatgacctcattttaacttaattgatgatttaaataggatctttaaagacctatttccaaacaaggccacattctgaaatatcgagggttaagacttcagcatatgaatttgggaagcacataattcagccagcccacaacagtgcctctttggaatgatcttttaccacttgtaaatggaaataattagagctctctatgaaacttgtgaaccctgtccttatggttttgcagctggttatggaatcacattgaaaaatagtagcccagggaggctagtttgctaattactacaggaacgtaggactgcatactaaaaacaaaaaataagtaggaagcacttggaaaccagttgcaggtcatctctcagcagccacctgtcctcgggacctatatgaattccccactgaaccttggatgctcacatgcatggcgtttgttccttgggaacgttccagagcagggtccaatctcactcatctgtgttaactacctagcacggtacaatgatgcacagtgtttgcttgtaaaaagcttgttaagctgcatttatgtatgaagatttttgttgcaaagccatttggaggaggagaagatgtgcttcgaattgctttcttaattaaaaattttccctaaaaattgagctaaacgttacttcccccttccctttggtcactagagacctcctctgtcagagaaccaacaatgtcttttttactctgacaatagtttgctctcaagttactgaagcagtaacttagacatgcctatccatgggaagcctgctaatttgtgcctgagcaaatttttgcagactaaggatggcttgcagctggtggtaggaaagctgatccataatggccaacttttagttttccctgtggtccaggtatgttctgtaaataggacttggtgctaggtatatgagccaaggactgagaaccaggaacctattggtggctatgaccaccctgtggctattgtgcagaaccctaccttacatgaggcatcaaagcattggcatccctgcctcaacctccctcatgcccttagattagcttgtgtggcttcgtacctttgccagcatcacatcccaagaggcttttttttctttttcaaaaaatatcagacggtgcttaaaactgtagcttttggtactttcagtgatcttgacatattgaagaaatctgattactttttctttttgttcttttcatggcatctgcatttttttgctgtttcctgagtgcagtgtccattttgttattagccaatgtatcagtcaaggttcaagcagaaaagagaaaactggttaagtttaatatgaataattattactataaaaaggcattagagtaatggtggattggttatcaacagtgaagagatctctaaagaatgcagcaatggcggatacagggaataactcttgcccctagagctggggcagagaacccaaggaagaaacagaactacaagtgacttccccatccaggcttgaaatccagaccctactgaagttagcacaaccatggcccttagtatggcagagaaaatcactgaggtgagtggtaattgccatgaatctgcactctagggtatctggagaagttctacacttttcaaatctgcaaggctataaaagggcatacctgaggaagtcatctaggtggacatgccacacctgcagaaatccctgggacaccactctttgggatgccatggatgttgcctatgagaaggtgccatgtgctgctggttatgcgcattgcaggagctgaggtttagagaagctagatgtgggggaatccaggagcttgctccatgggagccttttggaagcagcacactggaatctggaagagaaaatccctcttccttcactgtccctccagagccctcttctggcaaagcttaacagtgtatcaactggcaagggagaatgtctaaaaggcccaactttattattgcagaacaggcaatgaagggtgaatttcaagttgtgagaaggtaaattaataactagccggctgtaaattggtttctttgttttagactattgaagtacaaagagtttccataaagcacatgagttcttaaatgtaagttttaatttatcaaacatatattgagtagagggaagaattacttgctctaatcctgacaccgctaagagctaatgttggttgcaaacctcatttatgccttatacctacaataggggttggcaattgtcatacacgttttgcaggtaaagaaagtgagtcttaggggtaagtaaccttatcaaaagctgtcaacaggaggcagagatgggatttgaaacaaagtctgtttaactctaaggccaatgttttattttttctgttatattttactgtattctccaagtagaaattcacatgtgagtatatctatttctgcctcagaggaactgcttgtggtatgaaggagatgtggagtcccagtgacaagggcatggggaagactgcttcctatggaaggagctggccttaagctgccaaattggaatatcgggttatgatgggcagagatcagctctcagtctcatctatctggtatagtggattctgattggatctggagcaacagagcaggacagatagagagttttacatttgctcatagttccagaactctaacaccaataatttcactgttttaaatgcagattgaatcactctttattgagcacttacttctgtaaggttagaggaaccatcatgttcactgtattagtccgtcctcacactgctatgaagaaatatgggaaactgggtaatttataaaggaaagaggtttaattgactcacagtttcacatggctggggaggcctcaggaaacttacaatcatattggaaggtaccttttcacagggcagcaggagagaatgagaaatgaacaaagggagaagtcccttataaaaccatcagatttcgtaagaacttactcactatcacaagaatagcatggggaaactgcccccgttatttaattacctcccaccatgttcctctcatgacacgtggggattaggggaagtacaattcaagatgagatttgggtggggattatgggaagtacaattcaagatgagatttggttggggacacagcaaaaccatatcagacgctttcccaagtcctccctcatttacttctcacaagaaccccagggagtagacattgttaaatccattttatagattaaaaaagtagtaagaattgtgaatgtttatattcccaagtttattagatgataaacagaagctcatggcttgaatccaaatttggcagactctgcagccaatttattttcattggccatatttacagtattagttataaaataataaggatcctgtatactaaagcttctttcactatcatcagtttgggatactgggtacctaatttacctcattttaaaaaataactttgtgtagcaatgcatggcatttcacccatccccagaatcctgactgccttcacctttgggaggatgagaatgaagtaatacagtttaaagatatttatttgtttgtaagcagtagagatgggaaacagcttggccatcaacacagaatttggtgaatcagatatagactgatcttcaggagaatatcaggcaaagtgaagaataagcacaggctattgctagtgttgtcattaaacggacacaaagcctgataactaacttccatagaaataaaaattcttggttccatgataattattaaaggtgaaaaatgccagtgaagtggaagctgcccaagcctggagtctacataaacttgtacgggctggaagtgcacaggctctgcacatatgtggggctatttacatgtgcagagcaatggggaagggcactggtgggacctttaggcaggtcaaggtctttcccagggagccctacagagagaacaaaatccattgcaatccactttctgactgtaggcatcaaatcagttattggaaagcaagttgtccgtggtttggtgaggctctcagatgggtgaaagtggccaatatggaacattttatcaaaactcagcaaagttgcccagagtagaagtaattacattttacaagtggccttgtttgatataacctcctataaaatagcagttctctaagacagcagtatcagtagaactgtgaatgtactttttctgtgagactagataatatccaaaccctcagatgagcatagatgttgctcttttactgaccttggatacctgcaattttccatcattcgttttcctgtctgcttggaaatggtggtctatttgatataatcttaattaatttattagtgaaatagcacattagaacatgaggaaaaattataaacatatagttcaaaaaataataaaaaaacccaagatgtattttaaacaaatgaaaagatgctcaaacttaatagtaagagaaatgcaaatccccaaaatgagatatccacaaatgagatatcatatcaaaatgctaaaggctcacaatttgatatattttgttgtttggaggtattaggagagagtcactctcatgcattgctgttgggagtgtattcgtgtgaagtctttgaggccatgttgggaatatctatcaatactacaaagacagctattcgcacatgcaaacaaggatatttattgtgccattgtttgtaagcagtagagatgggaaacagagactggacatcaatacagaattaattgaatcagatacagactgatcttcaagagaatttcaggcaaagaaagaacgtggatagtatgagtgaagaaaaacagaataccaacataatgcatctgtttttgtaaacatatagataaactcagggggtccacattgaagaaccaataacgatgcttcttctgcatttgaaactgggcttctaggggacagagtagaacccttttgaaggcttggaatttggtacagtgcgaaaagtgtatacaagataaaatcccaggaagtcttttaagctagttatttcatgttctattgaatttgtgtgctatattgaggacatagggcattataattgagtgttagcatcctagggggctggctgtgtgccctctaaatgccctgtctagccatgtcctctgtatgggaaggtcagggcacaagtcccttttgtttcaggggcaacagaccagcctttctcttttcctcccatccgtccatccatccatccatccatttatctattcatccatccacacatccatccatctgtccatccatccatccatccatgcatccatccatctactcttgcatccatctatccatttatctatccataaaatcattcatttatctgtccatccaaccatccatccatccattcatccatccatccacacatctatctgtccattcatctatgcaatcatccacccgtctatccacccatccacccattcattcatccacacatctattcattcatccatctatccatgcatccatccatccacacatttgtctcttcattcatctatccatccatccacccacctatccacccattcattcatccacacatctattcatccatccatctagccttctatccatccatctatccatctatgcatccattcatctatccatccatccatttatctattcatccattgatctatttatccatccatccatccatccatccatccatccatccatccatccattcatccatccatctatccatccattcatccattaatttatctatccatccacacatccatccatccattcatctatttgtttatctctctgtctgtccatccatccgtccattaatctatcaatccattcatccatttatctattcatccattcacatatccatccattcatccatgtattcattcatccatccatccacacatctatctgtccattcatctatccattcatccatccatctacccatacacccattcagtcatccacacatccatccatccatccacccatccatccatccattcatccatccatccaaatctatctatccatccattcatttatctattcaaccatccacacacccatctattcatctattcattcatctgtttgtccatccatccgtccatccatccatccatccatccatccatccatccatatatccatctatccatttatccatttaaatccatccacacatccatccatccatccatccattcattcatgcatctattcatccatccatccatccatccattcatctatctgtccatccatccatccatctattcattcattcaaccatcgattcatctatctatccattcatccatcaatccattcatccatttatctattcatccattgacacatccatccatccatccatccatccatccatccatccatccatctatacattaatccatttattcatctatcctcccaaccattcattcatccatttatccaagatggggagaaagcaggctcttattagtatgaagtgcattgaggggaatcgggggatgctgtatccgtgggtttttcccttcctgattttggccaagtgaaaaagaaatatttttcttttatctactctgaatatgtctacttgtttccttttcaaatcttcaaattcctctgccccattcccctttgatgcaataagaaaaaggtctgaataaggagggaagagggtgatataactaagaaaataattgatataacaaaaaataatgaatacaacagaacaaataaacccagagctaatatcttgtgctatgacctagtcacattcttttaatattttcctctatcttaaaagaaagaatagctgcaagtaagagaggaataaatcattttctaaaattaaaagttagtaggtggtgtataaatgaaaccaaagcccaagacatttctcctaattaaataaaatggaaataagactttaatcacaggatatctgaaaatcctgacacacttttagttgggattatcagctctgagcctcattagttccctataatcttctgaaggtgattaattaaacaatatgattatgaattcatagatttaaacgtgttaaatgtatttcagtccattgctgtttttatttatttttcttgatgctcaaatgatcccaactgtggtcagtgggcacctcttcatttagaattccatgttcttttaaaaattaactttttaatttggaggcagttgtagatttacatgcatttgtaagaaaaaacatggaaagatcggtgtacccttcactgggtttcctaatggtaacatctcatgacactacctataatgcagtatcacaaacagtattctgccattgatacagttcacttgtcttccaatttcccattttactgtgtgtgtgcgtgtgtgtatttagttttatgcaggcttagcacctgtgtaggtttgtgtattcatcgccagcactgaagcagaacaaccatatcacagcagggtctcttgctttacctttcataaccacagccattaattcctacaccactcccccgcaagtccctgacccctgccagccaccaatcaggtcttcatttctataattttgtcatttctagattgttgtatacatggaattatacagcatgtaaccatttgggattgactttttaaacttagcataattccctagagtagtatccatattgtgcagatatcaggagttcattcatttttattgctgaataacattccctggtatgcatggtccacagtttctttaaccatttacacattgtgggacatctgggttgtttccagcttttggctattgtgtcttctgtttctcttttcttgccttcctgtggattacttaaacattgttgagcatcctcaccctaagacatgattttaggatacccattctaaaaaataatttattgatactgtctttgagtgtatctttttgcatgatgttcttacaaagaacgtctggctctagatattacaatacagacatacacacgtggcttaccacagttcattggcattgagattttaccacttcaaaccaggtatggaaatccacttcgacttaggtccctttaccttctctgcttttaaatatcatcatcttgactatcagaaggtgttatgatttatgttttaatcatcaaatacatttcataaaactcatggaaaacagtatggtctgttgtattcacccacatttctgctctgttgtttttttcttccttccaaatgctccaagattccgtttcatattttcattttttaaagtttttcttcatctgagaatgtctttattttatcttcattcctaaaagatatttacattagattcagaattcacaatgacaattcttttcttacgtcgtgataaatgttaggctactttcttctggctcccagggtttcagatgagagatttgctaacctttgagtgggtgttccctagaggtaacatgttatggttctctggctgctttaaagcttttactgtgttcagattttagaagtttaattatggtgtggtttaatgtagatttctctcagtttatcatattgagtgtttgctaagcttcctgagtctgtaggtttttgtatttctacaattttaggaagtttttcagccattgtttcctctcatactctttcagttccactcagtttctcctctctttcagagactctaatgacaccagtatcaaaatttttattattgtcctataggtacttgaggctctgttcactttcctatcaatctcctttctccctgttgcacagattgggtaccacacattgatcagctgtcaggttcagtggttctctcctctgccatctccattcttctactgagaccatctagtgagttcttgtatttgcgttattgcattgtccatttctggagaatccatgtggttcttttttataatttctttttattcattgagattttctgctattttgtttgcttcaagacaatttgtaattgcttgttgaagcattttttaaatgatgggtgctttaaaacactagccaggttattccaatatctgatgtgtctcaatattggcatcaattgattgcttttcttaattctagttgtcttttctttggttatttttataatgggtggttttcaattgtatcatgggtattctaagcaatataataggagactttgagccctatgtaaaaatcttttatttttgtgggtagtcattctacttaggcttaacacacagatcttggcccactttgtgtgctgtggttccaataagagtttaattttggtttatctgatgcatctgggactccctgatgctgcagtatgaaaggacagatgagatttctccagtccagctgcctccatgttggggagatggagcctccagcagttggagaagaaggggacttcttaggagcccaggtctttgttgcatcaggagccatcctgctgtggggcagccagtgtttccaggccaggtcacttgatattgtggaatactccttgccctgtctcctgggtgcttgttgtggttcctctaccctcaggggaagaacaaccatttgcctggctattcattaccagtgtcatccgagctgatccccctgttggtgttgcaggggcagcttggtttgttggaaggactcctggtccctccagagaggcagcccagctaggctgccttctgttactagaatgttagaaatgtgaggtattttggctggggattttaatgtgtgtgtacgtgtgtgtgtgtattctctatttgcagtttttaaagattttacagatcttctacatgtgttgcattaataatgttattcaacctttgcatatctgtatgcatttttggttagtatagctggcgtttactgagtatttgctatgtgccaggcctggtgccaaggtattggaatactaatttgtcttaatacttacaagagtctctatccctatttttttttttttttgagatggagtcttgctctgttgcccaggttggagcacagtggtgcaatcttggctcactgcaagctccacctcccgggttcatgccattctcctgcctcagcctcccaagtagctgggattacaggtgcctgccaccgtgcccggctaattttttgtattttttagtagagatggggtttcattgtgttagccaggatggtctcaatctcctgacctcatgagccacccgccttggcctcccagagtgctgggattacaggcgtgagccagcacgcccggcctctatccctatttttattgaatactgaagctgagagttcaaggtttttctctgtttgctgtgctggctgcttttcagctcctgtgccattgtgagggtctcctagtgaccctagggagatgtggttagactctcaaaccctccttaagcattgtccctttggcatttagactattttcagtattaaatgtaataatattgcaatagacatcttcatggaaataactttatattttatttaaactatttccttaggatagagtccttttatcttgagagagtaaagcatgtgcatttgttatggatcagtgactgcatttttctgataccaaattattttataaaagtcttatgccagtgtactctgccagtagcaataaatgaaaaaatataccaattttattctatcctcaatagtgttgggtaccattaaacaagtaagtattagttgagaatgtatctttgaggaagaaatgtgggcaagcattgattaatttggtcagtatatactggggacatatgctgtacccagcagtgactctaacactggcgagacagcagtgaacaggcaggtagcccctggatggacagagtcaaggagagaggtttcagaggactcacctgtgatgtgagagcattggaacttttcatgttattgaggaaggcattagctggcctgcaggcagatctttgctctggtggccacatcatatacagtccttgttggaagatttatcttaatataacagctgaataagagacatatccaaatatgcttcattttgcaggctaattacaccttttatattgtggacaaactaaaaactttatcagaaacactgctggaaatgtccagccttttccagagaagtggaagtggccagatgttcaaccagctgcaggtgagtggttggtctttgccaccgagggatggggagctactgctagggcatgtccgagacatcagggctgccctgtagaagattctacagagtcacatcaggcatagtggttctagttgactcatataattgacataaaactagagatgtgtgaaaactttttgtgaattttcagtattttacccatgcaaaatggtatcgttgtgagaatgattaataatttaatagtaactttttctttaaattctttattaagcttaatgctttttagattgtttgcatatttttgaattgcaggtctattcaacaatcaatgatcatttctgcatattctgtattgataacttaatatttttaaaaggaacgacttacagtttagaatggcctgactccattagagtctgacaatcattaatataaaactttaattcaggtagatcacctaataattttttgggcatttgtgtagcttcaacttaccttaactctgataggatgagaaaatatgcctgcattttaattcatgtttagtttttttattaacttaccaggtaagtagttcagagtatggactcaggagctagaatcctttgagtttgattcccggctcaacccctgccaccagttgtgtgatcttgggctagtcactgaagttctctgtaccttgagtttcttccctgagaaatgaggaagcgatagtagttatgaggtataaatgggtcaggatacatggagcccttggaataggttttgacacagagaaaatgctactgtgtgagtctgagttttccaagaagcagatgccaagacaggattacatgtgcaataattttattttgggagatagctgctgaggaaaggaagaggaagctagacaggttggaagcaaggttgtcagtggtgatgcaagtctgaccctgaggaaaggagagagggagagggtcgggtggaagcatcctggtgggccctgcaatttaatggaaatcagataaggccgagagggagtcacagagctaaagtcagttatcaaggtaggggtcccatgtcagtggagtcctgtggctcctgggagtgggcctgatgtggtggtcattggtgagagacagcccatgggaggcgtggcctcagggcaaagtgccatggattcagagtgcagcagtgggccctgccatttccgtttcctgcagttggaggtctgcgatgttcattctcacagcgaccatggccatatgtattagctagtattgtaatcttctttaatttgtttgtgtatggattaatttgttaatacagacatcagcaaacctttgcagttaatgggacagatagtattttagactagataaggtctctgctgcaactatatataatctcatgcaatattataagcaccaagtcgagaatgtacaaatatctaggagaacataaaacagtgcctaactcggcctcaaaaatagggcagctccttgtgaagtctatggtgtacctgagtactacttactaagtagccatgtcagaaatcagtcacatgttcaaccagttgaagaacttatcttccaaaggataagacggcgtaagttgttcctctatttcttagctttgggatcatgctcaagggaactcgcagtaccttgggtttgtagtagtcgatgtgtatgttgcaggcctggttctgccactagatggagtggttagagtctctgaggaaagccctaactttgctctgcttccctgttccatcagtaaaagacaacagtaccctcctggggatgttgttgagattaaatgacatgatgcataataactaccctgcacattgactggcaaatagcgaatgcccagtgaaggaagataaataagattccaaaaaagaaaagcaaacaccaaactttcataataaaaccttgtcatccttagacaagattagttaaaactatcacatgtaataaggtgaatgtgagaaataaaagagctaattacaaagggcacatattacttgagaattcctatatggacctcttgtgctattaggttatgtgctggaccaaaatctggatagtgtacaaatattctccaagaaattggcaaattccaaaattaattcccagtcattgatcctgaggcagagcctggatacatcagtatctttccctctcagcttcttgttggttgttgtatgttgtaagtgtcaggcagtgcaatgcaagtacatggatatcaatggcaaaataaaggggcaagatgtcatgaagttgatgaaaaaatcttggagaactctccacagtaaacaatttgtctccaatcattgaaaaatgaggcaaagtcacaaccatcaataataacgagagaagaatggtacagatgaagcaatgaaagatgcttccgaagatgaatagccaaacattgagagagggtttgggaaattctgaaatcctccttcagagttttcataacaatgaccctctgtttacaactggcctctgggaaaggccatgcaaaggaaaggaatcttatagaaaggttcattatataggttcgtttgaaaattttgccaaaaacaaaccacttaattcattctttgtttttagtattaacacataattacaactacaacataaattttcataattgttgattttgtttttcaaggtaagcttctaataagatattatcctgttatttattgtggtgttttaaaacttcttttaagtggattcagtttatgtgccttgttcctttgtaatgaaactttgaataagtctaataagtattattcaataatacgaaataatgcaattatttttattaagctatattatttttctttaggaggccctgagaaacaaatttgtaagaaactttgtagaaaaccagttgcacattgatgtagacaaacttactgaaaaactccagacatacggtaagtgtgctgatgggcatggtagtgttcttctgcccatatggctctgccacttgggtgggtcctcccccttgggccatggcattgctaggtgacttccagcaagtcacttttcctctctcagtttctattttcttatctggatcctgaagggcttgaactaaatactccccaaagtttgtttcatacctgaagttttttcgattcactgattcaggacttaactagtaaagaacctagttaaaaaggaagttttctgattcaaacacaagaattgtgaattacaaaacaagtttataaaagaaattattattattattgagttaaaagtaacttgaaagccattgcatagatttgaaaatgggaagctcagataaaaacattacctatcagtaaacatttattgtacctctgcaattgatgtatctgtgaattcatttaggtgttttaacaaacatttgctggacacacgaggagagccagttccatgaaataatccatagaggggcataaaatattcctgttccaccatgcagtgcagagaagaagatgaccatgcttagaaactgcaacactgtggcaaaatcagcgatcagggccctgccagagaagctctcaggagcctaacccagttggtggggacctggagtcagagggaggatgggtgtcaggctgttccaggtccctggctccctcacactctgcttgtacatgggaaagggtttcggatctgccttacatatgaaagttagaggaaggcaagacattttattcggcataatatagtacttccctttaaaaaaatttctggtgaatgcaatacttaatattttacttcagaaaggttaatcatattttaaaatgtttcatattttaaatgcattacataattttttcaattaattaaaacacctttaaaagaagaagtagcactggaaagtttataataatagtgtccccatcttctgttgctggaaccaaggactgacatgggtctgagagatttcctgtgtggaacgcagatgtctcctgagtttgcgtctaccatggtgctagtgttaatgcagatgtcttagagtgtgaatcgtacctgagccacatttgttcaacatgttgctgcttagccaacagtacatttgaataggttttcccacatgtaaacttctattgtaaaattaagagaaagttccccagaaatttagaacttttcctacaagtgtgttgggacacagaatatgagattcacatggaattttgagatccatgaggtgtgatcctctcttctttctgcttccgcctgacgctagagattgaagaccatatcatccaggtgaatgttggttattttccatccgaccctgtacagccctctgggagcaggcacagagtggggtcaggcattcacgggtggggtggcggtgggggattgatcactgaccagatgcaaatctccttttgtaactatgctaacaaatgaactcaccttactgcatgcacccttttaaaatttatacctaggtcatactcacttttcttcatcctataaacagtacctggaaactgaggtgactatttgaagatatactgatgcaacttttgggaatatttgcccaatcatgctgtcatttttattcattatataactttcattttatttttattttttttagacaagagttttgctcttgtcatccaggctgtagtgcaatggtgcaatctcagctcactgcaacctgcgacttctgggttcaagcaattctcctgtcccaccctcctgagtggctggaactacaggtgcgcaccgccatgcccggctaatttttgtatttttagtagagatggggtttcaccaagttggccaggttggctcgaactcctgacctcaggtgatcctcctgcctcggcctcccaaagtgctgggattacaggcgtgagccactgcgcctggcctcattatataactttaaaaaataactttttgctttattacaaaaagtatatatgtctgttgtagaaacattagaaaatacaaataagccagaaaacaaatccacctataatcttatcaccacagatagctattttaaaagcctcggagttcttttttaggtgaatttatatgtactcatatgaagataagaatatgtattttcacaaaaatgattatactgttcacataattttgttacctgagtctcctgagtttgcatctaccatggtgctagtgttaatgcagatgtcttagagtgtgaatcgtacctgagccacgtttgttcaacacattgctgcttagccaacactacttttgaataagttttcctattcaaaaattaagattattataaaagtttttcatatctataaatattgactgttactaagaaaaagtcccttcatctagctctgccttccatttcactccatagtatgaatttaaaattacttaggaatttctttgggatcggtccttatatttctaactgatacacctacggcagtatttcttgatttatttgttacaggaattatcaattgatttcttgttctgaaagatgcagatttagttttgtactacatcatttccctgatcagttgctcccactatggtaatatgaccattttagtagttataaaacagtatgaggagataaatgttgttcagtgcagagtcaggctatgcattataatgacattcccttatttaccatgtttcccttttcctagagtttcatgctctcttgctactacatgaaacacctgttctccattgctcccagctctgtgtgccaacacatcacctttatgttgagtcattttgtctgtgcagacgccacccagaccccctaccatgctccacctgggcaggctagccgctcctgccagcacccagctgctttcctaggaattctctgctctgctctcctggggtggataccatgattcctgggctctaggtcctcatttttgttttgttgtcatgttttgtgggttcatattaatcagtgtagtcttgaaaaagagaatgagagaaaaaattcctgagtgattttactcagtaaagtaaaattacatctgaatgatatgtggaaatatcctctatttcattaccaataattttgcatctcttctttctctctcctttttgcttttaatcagtcttgtcagagggttatcaatttttattagtcttaaaaaaacccaccgtttatggccttatatttcatttgatttcattgatttctgctctctattggttttttccttttgccctgtgtgtgtgtatgtgtgtgtgtttggtaacttcttgagatgaatacttaaattattcatgtccaccttgtcttcttttcttttctgatatatatatatatctttctgatatatatatatatatctttctgatatatatatatatatctttctgatatatatatatatatctttctgatatatatatactcatatatatatactcatatatatatattcatatatatatactcatcactagacacttccctctggcattaccttaactgcatctcactaattttgatatcttgtattttcactctcattcagttaagcatattttaaacatgtggtgtaatttcctttttttttcacctttaggttatttgaaagactatagcttaatttctaaatatttggtattatttatttatctttgggttaatgacttccagctttacttcacagtggtaagataatgtacttcgctaatacgatttcatttgcttaacatttatggagactcactcaatccttgcacacagggtcagttttggttcctgcattgttgggtgccgtcttgagcatcctcactgtctccttgttccatcagctcttaagaggtgtgtgtttacatttctcgttatgactgtgggattgcctatttctccttgaggttctgtccacttaggctttatatactttaaggctgtattgtattttctgttgaggacttgtttgagacatttatattttcctttgtttgtatttaaattatcttccagcctctcccccttcttttacttctttatttctttccggaagtttttctgtgactgacttagttatggtttcttatgagaatcctcttttggctctgtagcatttcttgaatcagtggccaaatatcttatatttggggaaagtcttggctactatcttttgaagcattgcttctgatcacttctctctctgctttcctctgcaactcttctaaacaagatgaaaacttttcacagtgttcaatgcttcttatttccttttctatataatccaacctattttctctttatacttcagtttgtgatttcttttcttactagttttttaatcgacaaattctctcttcagctgggtctaatctgctattaaacataccaatgaagttcttcatttcagttgttgcattttccgcttaaaatttaaattttcttattttaaaatagtttttagctctctggtgaaagtctattttcatctaattttggacacaatactcacataagtctattttcatctaattttggacacaatactcacattttggaagtgcatgtttgtgagctttaatacttgtcttttgtgggtatttttttagtctatttttctcttgcttttttttttggttatttttcttgtcttgtctccaggaatattaaggattaaaaaaattgaaaccagacattataaatggaaaattgtagaaataaatttgagtctcctgatagtgctatattcctctagataatgttattttcctgcttgtggcagagagctagggcagggccacgttttcctaatccatttggggatggagtggattgatggaggtagacttcagccttagtagggaaatttccagtttcctgtactcctggatagattccctatttgggtggggtggggatctcacctataaagctgataccgattagggcccatgtagatccagagctcaaagtcccgtggaccactggagactcagcctctcagtttttggcaggatcaaataccaggcttcccaaggttctcttttctcttgcatctctgacctttgagcttttgctgccttggtagctctttaaagtctttatatagattttcttttttttttaatttcaatagggttttggggagcaggtggtggttggttatatggataagttctttagtggtgctttctgagattttagcgcagccatcacctgagcagtatacactgtacccaatgtgtagacttttttaaacttttaaactaaagtctttatatagattttttaaaggccattcatattttctggttgttcttggaaggaaacttcatctgccccacattgtcctccattactctaagtggggtttcctcaatatgacctttcaatctgaagacgacagctcttcaattaaggggagttttcttgtcatcatttctttgatatttttacctctctataaaaataatgctattttaactttagtttattttaaaattactattactgttttctatttgtttattttgagttctctctttcatgttgaagggttcacttaaatgtttggtgatattatgtgtgaagcattaaaaccagactgaaagtgatttggtgagtagaagttattgtgactcagttcatatcagtagttctcaactgaggatgattttgtcctctaagggatgtgtggttatgtctggagatatttttggttgtcacagctggtcacagctactgccacctaacaggtagaggctaggggtactgctaaacatcctacactgcatggaacagccctccacagcaaggaattatgtgcccaaagtgtctgtagggcctaggttgagaaactctcatttagagcaataagatggagtcacttcttgaaaacaaatttcaggaggagacacgttggaatgtcaaatcctctggtctgttttggctgatgcctgccatgtctggggtcctcaggtatatacactgaatggtgaacaatcgttaacttgtattattctctggggcttggccccacattagtgtagaattttatactatgttgttttatgtccacctatatgtgaacctcagtattgtttttgccctttcagacttaaagtagcctgtgtttctttaccacatagggtttcacatgggccctatgtgtttttcttggctcatttttcctatatattgtgagatgaagcaacccaataagagctgtgattctaggactcttaccagaggctttgcccattcgtgtcctgtcctctgtaatccatctttctctcatagcagtgccctcatcatttaggttggggagtgtactcaaggtctccaaagtgatggaacatgcagttaatactagaccacattttatttttattatatctagtccattgtgcaggaactattacccaacaaagatattgcttctttcctcccagaggagggagatctgcccagtgtcctaagacctaagagtttttgtgtggagctgcttttctaagttgtagttaatgccacataataacattttagtcaacattgatctgcatacatgatgatgttcctataaggtcataatgagctgaaaattcctactgcctagtgactttgtagctgtcagcacattgtagaacaacacattactcacttgtttgtggggatgttggtgtaaacaaacctactgcactgccagtcatataaaagtctagcacacacaattatgtacagcacgtaatacttgatcatcgtaataaactactgttattattggtgtatgtgtttaattcaattcagagtgtacttcatatatatatttatgagttaagtgtaaagcagcctcaagtaggtccctcaggaggtatccagaaaaatccattgctagcacaggagatgacagctctgcgtgtgttagtgccctgaagacctccttccagtgggacaagaggtggaggtggaaaaaagtgatattgatgataatgaccctgtgtaggcctaggctaatgtgtggttttgtgagttagtttttaacaaaaaatttaaaaagaaagaaaaaacctaaaaataaaaacaagctagctcatagaataaggatgtaaagaaaatatttttgtacagctgtacaatgtgttttgtattttaagctaagtatgattacaaaagggtcaaaaagtcaaaaaattaaaaagtttataaagtataaagttatagtaatctaaggttaatttatttttgaagaaaaatttaaaaaataaatttagtgtagcttaagtatacagtgtttataaagtgtataaagtttataaagtgtacggtaatgtcctaggccttcacattcactcactgctcactgcctcatcagagcaacttccagcctgcaagctttattggtgagtactcaatctaagtgtatcatttaataccatataaaatctttcatatcatatttttattataccttttctatgtttagatatgtttagataaacaaatccttaccatcgtgttacaattgcctacagcattcagtacaataacattctatgcaggtttgtagcctaggagcaataggctatgctatacagctaggtgtgcagtaggctgtaccatctaggattgtgtaagtccactctgtgatgttcacacacgatgaaattgcctaatgctgcctttttatgccgcatttctcagaatgcatcctcatgattaagtgatgcatggctgtaagatgtacctatgtctcccaattatatgcatgataagaaagcttaaagccttctccaaagcagttccagttctgctactggaagataatgaaagtcacactatagtgagaccaagtcactcttcactgtgtttaacatctgctgttttatgcagttaaattgtttaaccacgcttgctaggcaagcttatagtgcagcctattccaaataacaaatggtcagcaacacacagatacagtagaaaaatgtctccagtttgccctacaccgagaaatttaacaatctccacttctccattaaaaaaaaaagccccccacaatgcacaatatactttttggttttctattttctagttgttatgcttactttcatgcagaaaagttaattaaagatattcagttggagcctcgctctctccttatagctgttacatgataatagttagcacttactgtaaatcagtttatagtgtatatataaacttcaactacatttacttttcacagcaatttcatgggtaattttgcttttcttatgctacagatgaagaaagtgaaacttttatagattaaataactatctaatgtgaaacaagataaatagtgcaattgccatgggagcaaagccatgtcttgtcagctttgaagcaccagtgacctgcactcctggagcagtgacagcaggggtcaatgccacttctatgttcccaaaccaggttaccccagcccatgtatttagtgggtcttgctttttgatgcctcccatggctataattgcccataagaatatccaagtttagcctcatacccacactatttagaaatcagaagaaccctcaagggagttttcatcacagccattgcataccccataagtaccagtcattacagtagcatttcacagcactgctgtctccagaacctgatacctcaatacttctagcaggtactaggtggtgttccagggcccatggaaaatcatggaataaacatgatgaaatgtccaaaggaatcacttttgcagcaacattttggggaaaatgagacataattttatatactgaaacaaatgagtagactagtacaatataacattttcacacacaaaaatcagttatttcacggaattttcaccttctcaaggctcatccaggatcctgtcttcttctcgcacacccttgtatccaccctcctccctgggtggagtaatttgagaagtgcaatgcaacaaggcaccgtcagcacagtatgctggagtcaccagccaagggctggttcagagatttggtgccatcttaaagaaggaaatagatagagaaaacagacaagaaatgttaagaactgctggtgtcagcactggctccgcatcagccagtccaggccagctgtccagccccagccctctgtgttcccacagcagataaattgggatgctgagtgtttcattttggttaggtggaggtggggctggaaatctggaaagtcccctgccacacaggacattgctttgtgctgtgctacctgaactgttattggagtcttaaagcaagataaaggcagtggagtttgtctcctcctctactggaaacaattttatatagtgtattaataaccgttatactaggaaatagttattgagtgctctctatgtgccagacacagtgtcaagcatgttacacattattctacttcatctttggaaaaagaccattgagcagatgattatcatttcccttccataaagagggcgaggattattcagcctcagatgcccactgaggggtggtgagcaggcacccaactccatctgacccatagtccacaaggcccagtagacggtggagatcctgtgtccctatctccaggccaaatgggcaccatgccaagataaattctttaaaccaagccacatgacctcttgttgagtgaggtgggctggaccagactgctagccaccctctaatccttccacgtcagtgctgagggaaaggcctcactggtgggccttacagtggctcggaggctcagaacttttccaaggaactctgagatgctgtgtcccagttgggggactccggggactcatgacactctgaggcagaagactcgacgctgtggatccttctagctcctctttgattgtgtcatccaaacagccaaaggtccttttctgccttaaaccttagaaagtgttgactataaaactaaatgagaaatgaaaactgctgtgcaattacatgtttctgctattgacgccatttgagaactctggcttgagctattttcttctcactgatttttccaatgagcgtgttttattcttctatgaattcagtttgacggtcttaacttaaccaggcccttcaggctctaccaaattgggaattacaggaggatttctatgagatgtgtgtgtgagctctgatggcaatagttaattgatcttatttactaaatggctttatgccttttttatatcttttatttctctctggaaaacagtaccaagattttcattctttctgaaatatagatgataaatctcaggcttagagactggctctttcagagccctacaatatttggtggaatcaagaacccaattctttgaattctggatcatgtaattcttctactatgtgttaggcagggctgtctggaattcctgatgtttgaatatttttaacacacagtaagcagaagtttcatatggttccactcaatataaatgcagcctggtgtatttgtaagaaggtggacccaaaagctagatggcatgtgtttgaatcatggttttgaaacttactggttgcttatactctttgtgccttaattcctatactttaaaatgaacatgccactagcaattccctatagatataagggttcagtgagacaatacacaagtgcccagaattgtacctggcacaagactgacactcatacagtgacacttcactattattgtagatatttagcaaaagcttaattatcagaaatccagccttcccaaatccttacactcatgtcttggcctgagatcggcaaattactggaacataataacagcagttacaacataatgaataacagtcttttctttgagaaactgtgcaatgtaggttgaggggatgaagggcagaaggagcccgacacttcttgatgttgtttggcagcttacatgttctcatccatctgaagttggcagatggaaactaatctttccttaccagggaagaagttgaggccaggacatgtcaactgatttttctacagacctcaggatgatggagatgcatcttcatgtagtttcttattcagggctggcccccctttacagagccccaacacccctttcaaacatgggctgggtgccaagcaagcaaaacccagacttaatccagaaaccttggaagccaggaggatctgggagcagggaaaccagtagaggagggaagcaagcatgagaggcagaggcagctgtcagtgggtactgatgctgccatgtccggggacaaatgcccacaggatggcaggtaggctccaagcttcgatggagggtggaaatgagcacagggagcagctcacatcatttggaaagttgagtgttcaggaggtcagtgagatacaggagggccagcaggaagcagtgactgcacacagggccagggatagactgttgtctgtcaccatacatctttcctgctgctttccctctggaggtcatgttctgggcattcccacgctgccttgctctagatcatttggtttttccagctccttcctgaaaccagagtgaaaatactgagatatcctcagccttttgccctgaaaatgtttgatgtcagcattcatagccaaggtgttgcgactttactctgctgctctatttatgtttcgaatgcacagatccaggacaaagactacacaaggatttggtttcctcagtgtccatgctccttgataattgcttttgcaaaattaatttaataaaatgactttcccaaaatgactgcttcagggaaggcgtgttttttttagaattgcttgactccaggttggaactttttttttcccctgaactctctgtgagagggtctttcctatcacatgtagactttccttctgttgtttatcctgttgtctccaactgtgtttccttaggctgctgtattaccctttgtgctttaactgtttttttttcatgtacatgtatcagtgttacagagcatgtgtataaaagtgtagagtttacactcagcaagtaaatgccaaatttcacatatgaccaaaatttgactcttttgagcaattttttagtggaagaattcatattcattttcaaatccatttgcacaatctccactatatgagtggtaagcactggggggatacagaagttgatgtgtcctaatctgttcactttcctcaggagggctgctggatgagatgtttaaccatgcaggcgctggacgcttccgtttcttgggcagcatcttggtcaatctctcttcctgcgtggcactgaaccgtttccaggctctgcagtctgtcgacatcctggagactaaagcacatgaactcttgcagcagaacagcttcttggccagtaagtactcaatgaaaaaatatgttcgccaagatgccaactcctgtaagttgtcattttgggagtttctccctaaaggtgtcttatgatagctcagaaagaaaagaagtcctttccagataaaacataaaataaagcagaactgtttaccttggataaaacataaaatgaagcagaaatatttgccttggttaatgaaaagttgtaccttatgccatagtgactaataacgttttcaccatcctaggaccaatgctatttactgcatctgcttttacccttttataacatcatgttctagttaaatctcacaccataagttatattattcccgattaaagttatactctaatttcctgcatcacctttccttttatcagagtatcttgatatcctggttggggcggagagcaggcaatggccaactctgctccattatttaattgttcacccattcaagataaatatggtggtgctctcatattcttttggaatacacattgaattatttttaattgaggttttgtattagtttcttaaggttgctgtaacaaagtatcgcagactaaaacaagagaagtttattgtcttagagtgctggaagctagatattccggatggagacatccactggtttttcctgcgggctatgaggagagaatcttctctaggcccctctcattggcttgtaggtggccatcttctccctgggtttctgcacctcatcttccctctatgtatttctctgtgtttaagtttccctctttttataaagacaccttcatattgagttagggcgcaccctaatggccctcattttaacttgattactctttaaatgttatctccaaatatagtcacattctgaggtactgggggttaggacttctacatatgaatttagtaagggacacgatttagctgtgataggctttatgcatacaattcaaagaatccgtgtggcataaaatagaatccatgtatttaagttatgaatgataagtaaccccaaagagatggattctgcacattgagttaacatctgcaatcaagagaaaaaaaccctgcaaaaaacatctgacaaataatttctttgtgttgattataccacagtttgcttttatgaaaaatacaaagcagcactggacagggaattaagagatcttggtttaggcttaccaccaattgcctgtgtgactgaaagtcagctttgccactgcgggctggggctctgagtctgcaggagtggagggctgtgagtctcaggctcctgcaacttttcctgtctcacccagtgtaggcgtggtttgagccactccctacagtgtggtaatgcttcgtttttccttttctgccactaggtatcattttcagcaattccttattcgacaagaacttcagatcagagtctgtcaaactgccaccccatgtctcatacacaatccggaccaatgtgttatacagcgtgcgaacagatgtggtaaaaaacccttcttggaagttccaccctcagaatctaccagctgatgggttcaaatataactacgtctttgccccactgcaagacatgatcgaaagagccatcattttggtgcagactgggcaggaagccctggaaccagcagcacagactcaggcggccccttacccctgccataccagcgacctgtgagtagcctggggcaggagccaccgacagtgagaagggccttgcatttgtctagctgaggagagaaaactcagtttttctatggttatttcaaaaagcactgttaaaaaagttcaccccccactttttaatttcgtaaggttcattttttttatatgcttgtactcttcaggtagaagaaatataatggttgagataatacaatcaagtgaagttttaaatttgacatcaggcatcatctatagttttaaatacacttaaaataaatttgatgaataacattcacaagggctgtgcatgtccaacaaaagattccacttacctaaccttgggaaaactgagggaggttattttctctgcagtgcaaatccttagatataggctgtatactggacagggtggtgaaggattccatacaggccttgaccatggcttgggtacccatgaagtaatatgagaacatttaggagtttgattgtgtaatttggctgctgacatctataggaagaggggaagctcagtgaagggctggagcagctggacaagaggacttggaggggacatcatggaggcattaaaacagccatcagggaggccaggcaggggatgtttgcagagaggacgggagactatggtcggactggggctcagtgaacctgagggtgagcttggacaccttggcaggttcagacaatgaacagacttcaaagctcaccaaagcggggtgagccgtattgctgtgggctgtggggctcagcctggatttcttactttcctcatggtgcatactgttctcataagcattctgctcccacagctggcctggctctggataatgtaggtcattcatttgcaatccctgcatgctggctctgatgcagggcctcaggaaggtaccaccttcctaccctctctcaaaagcacactaggaagtaagtggctgaacatgaggctactgaagggaccggtttgcgtgttctcttagttatgagaacagggacaagtactcatccttcatcgaaacactgccagtaacaactcatggcacctcccacccctgactggggcagagccatggaccaccaagcagaagtcaggactgcctctccaggtgactgggcgacacacacgtgaggataggtgacttgatgtcttgacccctccttcctgtctagtgataggctgcatacataatagcacatccacacattttttatgaaaatgctggttgtacaggaaggactttcccacagtgggaggataaaaggctgaagaccacctgattgaactcatcttgggatagcctagtgtggtgcggtgaacaaaaggtcaggaagaaagagactaaggcgacattttcactcaggggctgccttgttaggcagactgttagtaagcctcttaacttctttctttgtaaaatgatagcttttctttcttttcaaagtgatgatatttttggctatgaacattttcaacctgtgattttctgctcctaaagcatgtttcttggaggtgatagcagcaggagcagaaccgaagaaaagtgctgttgttggctagttgtcatgcacagacacttcatacccagtgcaaacacctgagagctctgagaattagtgatctgtgttagatactgggagaagccgaagttttattatgctcattttctaaaggcaaacctgaaatctattgcattctgacaatctccttctagctccaaagtatgctatgatctccacccatgaaagagcggggttgtgcttacgtggatgggaacatgacaattccctctgctccggttcacaggaggagactgggggtttactttgtccactctgacataggatatttcccaagaaggcacgatgggaagaacagcatacactcctacaaatgtattgatggaaatccagaaatggcctgagtaatcagttttcaattcctactgatcatagtgtatggctaacagacattgcaagagagctagaaaggaggaattgagggacatggatggagacatattttttcaccccttgaagataaattctgatgtatgagaaacattccagcctaaaacgttggaatgagtggaatacccaggtatgattctgatctcatggaattacctctcttattctactactgggatacagcaatataactcctcagaagtattgctttatttctttgagaaagatgaagaagtattttaattctctgaaatatttaaatctttgagatttctcactgtgctatatccatcttttatctcttgtttcgaagtctccctttcttgagggcttagagtacctgcagtgattgaaacacagtctgagatctcgaaagaactcagtcacttgagtaaaaatcctaaagcacagtttgtactgtagacaatgtttgttaaaatttttttagcagtttcctcctgcttactgaatgagctacatattcattaatttatgaatttattcaatgacttttatgtactatttgtcagtctctagactgaataagtaaagaaaataagtaaatcagtaaagaaaataggtgaatcagtaaagaaaataggtaaaaatccctgctcttgtgagacttccagtccagggaagcagaggtgccacaaatacaattaagaagacaattgcattgaatgataggaagcaggaagtgccgtggagctgggaaataggatgagcagggtcagggacactaggaggggaagatggaattgttaatgtggatggggtagaccctatcaggaaggtagcattttaacaaagacttgacgggatgcagaagcacaaggggaagtgtgttctagggcagaggaaccccccatgcaaaggccctgtggtaggagtggcctagggtatgtgtgaagagtcaccagagcagagtgcacaagggcaagagggtgggagatgaagtcaaagagctgattgtagattgcatggttgcaggtgactggagtggtattaaaagactgctggagagtttcgagcaggagtgatgtcatcatctgacttatactgtaaaagtcttgctcacgctgttgggtggaaaagagcttgtaggggtatgtgtgggacagagaaatcatttagaaggctgttgtaataacccaggtgagagatgatggtggcttggtccagtgtggtagcagagaagctggtaaaaagtggtctgattcttggttgcattcaggaagtagaggcaacagaattgccaaaagatttgatgagggcgtgatagagagacatcgaggaagattcccctattttggtccaagtaactggattgctggaattatctctaactataatagaaaaactgtgggtagaggtttggaggataaggatagaaactcagctttggacatgtctagtaggcagatttgttcaggaggctgggacaatgtatggatctattaatttaggagtctccccgattttgatggcatttagaactctaagatattaccatgggaaggagtatagatagaaaaatagagagggccgagaccaaatgtggggcccctcccatgaagaggtaaatgagaagaggagattgagaaagtatcattgaggcaggaggaaaacctacagagtgtggaatcctggaggtcaagctgagcaaaagactccaggaagaggagtgatcaagtgtgtcatatgtggctcatgggtgaaataaggtaaagacagataatcgaccattggatttacaccatccaggacttcatagagagtagcttccatgatgtggtgagaatgacggccaaattagagtggacagaatggagacttggaggggtagaattggagagtgaactcagacagctctcaatgggaagaaatgggaggtgacttcttcttcttcttttggaagaagtcttttttttttttttaaatataagatgctacctggggaatagtccagtaagatgggaaaattggtagtgtataaacgggggggacagctgtgtcctgaattagtcaaggggaagagacctcaacaagtggagagacctactataggtgggaacatggcaattcacctgtggtaacaaaacctgtttaactctatttaactaaaaattttccacttttcttgcacacagatctctctctctcctccttttatttttcatgtagtatctaccagcagctcatggaactaatgtcctgaaaggcatgcattggaaaatgttgctggagactgtagagatggataggcagcagcagtttttgaaattgcatgttcctatcaaccccctgattcataggcagttatcatagaataattttatgattggaactgtagtgtgtacttcatgaatataaaggaattcaaatgttaatgtgttgcttcaaagaataagccaacttaataaacaggttttcagaaaacaaaaaccacaacaatatcctgggattgttttatatgcacaaagaatatttatttgaaaggtcacctgttatttcctctattgctttttggctgcttcaattcccaccaccctggggtgggttcaagagaaggagaaatggagcgtgctgggtcaggctgagtgatggctcccgtgaggcgttgcatctggactttgatgtgtcttgggcaaagtggagagtgaagggttgacagccactcatgcttgaaatgttgaattcctgcttaaaaaaaaatcagcttgatccacaacagaccagtgagaggacctctcattttatttattttgattgtttctcttccttgggctctacttcaggtaactttattaaacacctctctcttccatttagtcaatagtcattgttctcagcagaaattcccattcttgatgaccctcagcgctcagagctgctggaagccccctctgttgcccgcaggctctgtcctgtcccaccaacgcaggtaatttgttggtgataccaactgtagtgggaaggagaagaaaaaccctcattaaattttacaattcttcactttctcaagccccacacagctcttacaaacttatctccttgctgggcagaggaggatggtttctcattaaaacctcagcaaatcgtttctccaatttgtctatgttctttccctcaacagcagcaaagtaatctcttaaaattgtatcacatttaaaaaaatcatctcacttattctctaaaaaccttaaaagtacagtggaagaaattgagacgctgatagggtaagttatttcccccaagatctcacagcatcttaatacccctcactccccaaataaactattaattgccacttgctacttttaagcactttgtgcaggatgcttggtcacttggctgccatttcactccattgtatttgaaagtctggtatgttttcggccgggtgtggtggctcacacctgtaattccagcactttgggaggccgaggcgggcagatcacaaggtcaggaattcgagaccagcctggccaacatggtgaaacccggtttctactcaaaatacaaaaattagctgggcatggtggcacgcgtctgtaatcccagctactcgggaggctgaggcaggagaattgcttgaacccaggaggcaaaggttgtagtgagctgagattgcaccattgcactccagcctgggtgacaagagcaaactccgtctcaaagaaaagaaaagaaaaaaaagaaaggacaggacaggacaggacaggacaggacaggaaaggaaaggaaaaaggaaaggaaggggaggggaggggaggggaggggaggggaggggaggggaggggacaatgcctgcctggcatgttttcttatatcctagccagagctcagatttgagcagtagttcttaaccttggttggtgggagtttggaagtgtatggggtgttttgatggtaacagtggggaccagtgtatgtttagtgcctaagggccagtggtgacaattgttgtgtgataaatgacactgtagtgtgcaatgaagaatagtcctagccaaattccaaaacaccctcatttagatccactgtttgctctgcctctggtaaattatttcaagggccttcatcattcactcatatagttattcctctattcatctatgtagaaacattttgttttcatattcactgtatgacacacattctatgctgggatggatgcagagatcagcactatgcagttcttgaggtctagaaactcactgcttaatgcagtagttagtgtacattcataactaataaggggcgaaaagggagatacagatactgtaaaagtggcagcactgggttgctcacaattgatttcatgccttcctctacctagtaaaatataggagaatttcttggtagaatctgtatgacctgagagtctgaattaaggtctcaaagtctccttctttagacatattggatcttgacagtgcatctcaccttctaagtttatccgatctctttcgagcttcctggatccctttagagtctcagacttgacatgatgacagaactgggatgaaaaaactgcatttgggtgccagctttgacacttgctggttcgcaggaccttgggccagttttgcgccagctttgggtgtcggtctcctcagctcatacggggtattaactgctgtctgcccagtgcattggcttgtagtgcgcagtgaattatcctgcttgaggagaccttgagacttgtgaggggcaacgccaggcactgtgaatgggtgggatgctctgagtggcagcccactccattcttgggcagcttcaaatctgagaaagttcctccacctactgatgcagaaggtcaatctgcatgactctggcaatggctgagtcaggaacactagagtcttaaatgccccttacttcaccttccctgacctccactcacctccaattcacaaatcacgtcagacttcagctggctgtgttgtgcggaaggcagcggagacagagctagcaagtgacaggggcaacatgagtgtgcctctggttccatgaaaaggaaagggaggataaagggagagagagaaagtggaggccaaatgcactggtccttctcttcagcagttgcccccagctatgtcctgtctccccatggttgatgtggactggtcctgggcagtagtggtgatggaggccggtggagaggggcagaagcagggaagggcagaggccgggctgatgtgagaggtggtggctggaaatttgcctcctccctgcacttgcctcaaagtcctacatcctgagaaaacaaaacaaaaaacagacaacaacagcaacaaaaaccagctgatttctcagggtggttctttctatagtaagactttggtccaacacgcccatgacttttctgtcattgcactcactgatagtgctgacagaggcaagtaacagatcaaataccaggagcaaggcttactaaaatggaaaccaaaaagtccacctgcagaaaaagcaatggtgacaattagtgtttgtgaagatcagagtatccctttagaaaggcttaaagaagtaagagagtttaatttccttttttgtttttacttttattttattttattttttattatactttaggttccagggtacatgtgcacaacgtgcaggtttgttacatatgtatacatgtgccatgttggtgtgctgcacccattaactcgtcatttacattaggtatatctcctaatgctatccctcccccctcccccaccccatgacaggccccggtgtgtgatgtccccactctgtgtccaagtgttctcattgttcagttcccacctatgagtgaggacatggagtgtttggttttctgtccgtgtgatagtttgctcagaatgatggtttccagcttcatccatgtccctacaaaggacatgagagagtttaatttcctaatggtataatttatagatagttctttgatttgggttccagagaaggggaaacatacagagaatattctcgattcttagtttgattcatgctctcctgataagaggaaaatcctatttctgaggttactgagacatccctgacctttgtgtgtatgttttttatttttagttctataaacaagtgatattcaagagtgaagaaaatagagaaaataattcacacttaatatcctgttccaaatagacacttatttgtttatttatgttttcttttgggatgagtccctcattctttgtcgttgtgattcatgttttacaaactagaaatcgcaaagtcttgccaagagttagcctgaaagtttttgtgctacatactcatttgggaactatttacgcagtacttattatgtgtcatgcactgtaatcgcatgacatatgtagtagggaaagatgtagtcctgccttgaggaagcttggagagcagggattgttatgaccgtattaagatgagacaaccagcctggacagcatagcaagaccccatctctacagaaaataaacaaaattagctgggcgttgtggtgtgttctgtagtcccagctaattgggagggtgagaggggagaattgcttgagcccaggaggctgaggctacagtgagcccagatcatgccactgtactccagcctgggcaacagagtgagaccctgtttggaaaaaaaaaaaaaagacaagaaaactacgaatgacttaaatctgctctgctgtgaccccgctctagtggagactgcaagggacgagaatcacagcacctctttaaaacttggtactcagtgcagttgttgttggtgatacataatacataatgcttcaactttaaatatgaaccacttccaattattaagatcctagaagagagaaattaaagtcaaaaaatgaaacaattttcttctctccctttctccctactcatcctccttcattcctctctcggtgtggttactcctcttttaacatgctttttccttattttaaaaattcatgatgtgcaagttatttcattcttttcttatttgacttctgttttctcaaagaaccctatttggacttcatcaattctctcttttgtctcatctaactttttctgcttttatttttattacttccttacttttctgtatcttcaatatattcttttataatttgagactaaagtttaattcattatttttagtttttttcttaaatatttgtagttaaatatattatgtaggtaatatatttaacataaggtaatgactgttctttcaactcctaccttatatcccatagatctcatatgtagctaacaatttattgttttctagatgcatgcagtacaggtttctattttctctttgacccaagagctgtttaaataaagcttcttttaatttccaggtgaaaattctcaagaattttaaatatatgaaaaactatgtttacacagcttacttgtaataagaaacatacaaattaaatctgctttgtaatagtatgtttttacatatcagagggacaaaatacaaaaattgcattatatactaaattgccaagttctgttgctaaatcttaatttctgaattgcagtcaaaatatgattcttattatttctgttttggtatcaagtaatatataacccacttttgtgaatgatttgtagacacttgaaaagaatttctaattccctattttagggcagagaatttggtctgtgttatttttgttatgtaggatttttctatccttaatttatgtcgtcttgatctgtcttagactgggataggtaaattatactcccttattacttggttgtccttctctctttttcctgtggagtttggcttttggatatttgtgctttgttactgtgtgcattactatgaataattgtgtcttttaatgctttgtggacataactctaccttgtttgatattgaaatggtgaactctgctttttttcccttctcttcactcttcctcttcttcttttttttttttttttttttgccttttggtgtttctatttgcttgatatgactttgcccatcctttcatttaaattttttctgaagcattttgtttcaagtgtgtctcttgtatgcattatatagcttcttatatatgtggccttaattctttgatagtataaaatgcaattataaattatatatagtcttgcctctatcttgtgtttcttatgcttataatttttcttttaagctaatatttaataatgttttattattattgtagtggttaccttataattataacattatataagtaatataaacccttgtttttttatcacaagcaataaaaacttaaaatatgttctcttatttcatcatatattttctcttgtccatcatgcaattttagctggtattgttaatcttacttaatgttgccttttgtactgttaaagacacttatactaatattctacatttgccaatattttaaaaaatagtatttgagtttggcatgcaccaactttttcttcgtctctaactcattccccattatccttccatttgtttttcatatcatttctgcatttcagggaatagtagcatttccaatctgtcttgtaaccttaattcctgtttttgttttagtcttgcttttacaggaaaatgtactcattgcttaccatcagccctttcactgtaatttaccagtcatcatttggcgggatgaagtttgccatctagtaatttccttaagaagctctcataagataatataacctgaattcctacatacgtaaaactctttgtagcatttatatttgaaggacatcttggctgaatagaaaacccttggttcattccttccttaagtatcctgtaaaaattgtctttggtcttaaatgttattatggagaaatctggggccacattgttattttctcccttttatataacttggtaattttggcaagctgccagtagcttgaaaacgcaataaattttataagagtatgtttcattgttgaacattctaggacaattttctatgatgacaagacaagtcctttggatgtgtagattttaattttttttaatggagactcttgatgtattctagctttgcaaatttagaaatacttagtttttctttttcagggagtttaattgcctgcgtttcttttccctgtgtttctaatcaatagatttttacattttaaaaaactctattcctgtttcctttagttgcatttcttgcacctattttctacatcccttactgtattttgtgcagtatcaatttggcctgtgtttcttccaattttattctcctttgtctgatggctagtttttttcacatattttttctaagttcttccaattcccattttatatctttctgctactttaccatctcattaactcaattctaatgattgtgctgtgtggtgtttcttatagaggggcttgccttgtttaaattgtttaaatatatttaaattgttgacaaaaagtatgttcactattatcatctgttcaatgagaccaactttttcgcatgggtttttcacttgttaataattatgcaactctcaatctctttttatttcttgcccaaatgttgtgctaaatttttgttaccgtgattgttactcatctggaatgaattggatattcctgtccaggtatctgcaagagggtcctggtggtggtgaggaccaggtgccattaatgaccttacagctcaaaagcttacttttccattgccacaaagatagagtgcttcctgaaaacatatggatttctcacatagcctccgtcttctgtttccctggaaatagggtctaggagaaggcttctcacgctagtcaatgtaacttttttttgcttttttattgatacacagtagttgttcatattcatgagttacttgtgataattggatacatgtgtacaatgtgtgataatcaaatcagggtaattgagatagccatcacttcaacaatcatctctttgtgttaggaatattacaaagcctgtcttctagctattttgaaatatacaagttattgttaagtacagttcccttagtgtgctattgcacactagaacttatcccttccctccatttgtacacactaaacaacctctaattatcttcccctcccctttacccttcccagcatctgggtaactcactactctactttctacctcaatgagttcattttatttttagctcccacgtatgagttagaacatatatttgtctttctgtgtctggcttatttcacttaatataatgtcctccagttccatccgtgttgcttcaaataacaggattttttctttgtaattgctaaataatattccattttgtatatatgccacatttctttatcttttcatccattgatgaacacttaggttgattccatatcttagctattgtgaataagtctgcaataaacatgggagtgcacatatctcttcgatatactgattttctttattttagatatacactctgcattggaattgctgggtcatattgtagttatattttttagttatttgaggaaactccatactgttctccacagtgtctctactaatttacattcccacctaacagagtgtgggttttcccttttctccaaatccctgccagcgtctgttattttctctctttttgatagtagctatttcaattggggtaagatgatatctcactgtgggtttgatttgcatttttttgatgattcatgatgttcagcatatatttgtataactgttggccatttgtggtcgtttatttttgagaaatattgagtcagatcttttgcctatgttttaattggattatgtgggtttcttgctattgtatttgtttgagtttcttgtatattcaggctattagtcccttgtcagatggatactttgcaaatattttctcccattctgtaggttgtctttacactttgctgattgtttcctttgtttgcagaagctttttagcttgatgtaacatcatttgtctatttttgcttttgttgtctgtgcttttgaggtcttacacaaaaagtctttgtccagaatcagtgtcctgaagcagttctctgatattttcttcttgtagttttattgttttgagctttacatttaagtctttaatctatttagagttgatgtttgtatatggcaagagataaggctctagtttcattcttctgcatatggttattcagtttttccagcatcatttattgaagagatagtccttttcccaatgtatgaacttggagcctttgttgaaaatgtgttggctacaaatgtgtgggtttatatttgtgttctttattctgtttcattggtttatgtgtctgtttttaaccaaagaagtgaaagatatctacaaagaaaactatgaaatgttgatgtgatgtgagaagttaaagaggacataaaaaatgaaaagatatcctatgcttattgattaaaaaaattgttaaaatgtctacattacccaaaacaatctgcagatccaatacaatccttattaaaataccaatgacattcctcacagaaatagaaaaaaatcctaaaacttatatggaaccacaaaagacccagaataaccaaagctatcttgaggaaaaaaaatgaagctggaggcatcacactacttgtcttcaaaatataatacaaaaccatagtaatcaaagctttagtctccattttatttatttctgctctaatataaagtctttcatcaaagaaaagcccaggacctgatggcttcactgtgacccgtgttctgcttgctccaacctctggtccttgcccttttttttcctttgcctggagcagtcttcctttagatacctgtgtgactcatttccttacttcatccgctttctgcttgagtatttttttcccgctgtcagctcagctaatcaccctgtctgaaatagcattccttctcacttttggttaagctagttcttttttactcatagcatttatcactacctgatattatgcatctctgttttagtcctttctgtgctgctatcacagaatacccgagactgggtagtctgtgaagaagagaaatttatttggctcataattctggcaggaagtccaagatcaggcagcctttctggtcagcttctgctgagggtgtcatgccacttcaactcatggcggaaagtgtaaggggaagagggtgtgcgctccatacatgagaggcaaccctgcttcataacagccagctatctcaagtacctggaatctatcaatccagtatcctggaaactcaacttgtctcatgagaactgcattaatccattcatgagtgtggagaccccataacccaaacacctcttaaaggctgcatcacctctcaataccatcacatgggcaattaaatgtcaacatgagttttggcagagacagaacatagcaatctctgtgtttattggattattttatgtcccctcccaccttgccgacacactggaatgaaagatccttaatggcaggacctttttctgtttggctcattcatgtatcaccagcccagtaacacggcttgtaccttcagttggtctcaatgttgaataaataattattatgtggatttagagctcagagagtatgtggtgagaagacagagggtccagcttgaggtaggaatgcctacatttaaaggcaggtaaaggagaagttgccaagatgtgggtgcaaagctgggagttgttctggaagctaagagaaaagagaggaggagggaatgaccaatgccatccaacatgtctgagaactcaagaaggaaaatgactggataattctcattggattttgaggcatgactgtcattgatgccctagataagagtcatttcaagtgtatattagaaatggagcccagttagagtgggttgaaatatgagtgttaggaaaatagaaaggaagactttcatttgccaattttcacgtattttgtagatgataatctgtgatcaattaatatcaataattgaagatagataatggtcccaattaaatgggggaaatggcaggcatggattaatgacctgctttgctccaacctgctctgcctatggcaggtgtcagagagtattgtggttgggctatggctctctgagagatctcgaaccagttgtgtctccttcatgggttccttcatgaatttgcatacctacaaaatcagcacaccaatcatggccctcctacctaagtcacaggcatgtagaaatgaccaaaggagatatcactcctgaaagagctttctaacttggaagaaaaatgtaaaaaattagtagagtcattttgcttgtctccggatgctgactgaattatccccttacagattcctgaacaacgttggtttcttttttccactgataatgatgctgacgtggatggtgtctgtggccagcatggtcagaaagttggtgtatgagcaggagatacagatagaagaggtaaatatccttaaaccttgcctgggagacaaagatagggaggctggggactttggaaatggatcttgtcccataaccaacctgagcctctctgttttgcttccctctcctctgctggggttctggtgtacaaaatagctgagtccctgttccagaaagaagattttatgttgaagtctgaagcaatgccagatattttccactgacatgaaagaaagccaaagaatagccacatgagattgcaagaacaaagccagtgttcctcattcagcaacttttttaaaacccagaaaaacatagcagcagacttcccatcttaatttatgcttagaattttttatgtagagaccctgctattttttttgtaatactgttataaaacttgaaactatcataacttaaatttttttatttccataggttttttggggaacaggtggtgtttggttacatgaataagttcttcggtagcgatttctgagattttggtgcacccatcacccgagcagtgtaccctgtacccagtgtatagtcttttatcaatcaccatccccaaccctttactctgagtccccaaagtccaaagaatcattcttatacctttgtgtctcatagcttagctcccacacgtgagtgagaacatatgatgtttggttttgcattcctgagttacttcgcttagaataatagtctctaattccatccaggttgctctgaatgctattatttcattcctttttatggatgagtatatcccatggtgtgtgtgtgtgtatgtgtatatatatatatatatatatatatatacacatacacacacacatttatatatatacatttatatatatatatacacacatatacatatacacacacacacacacacacagacattttctttattcactcattgattgatgggcatctgggttggttccatatttttgtaattgcgaattgtgctgctataaacatatgtgtgcaactatctttttcatgtaatgacttcaggagtgggattgctggttcaaatggtagatctacttttagttctttaaggaatctccacactgttttccatagtggttgtactaatttacattcccaccaacagtgtaacagtgttcctttttcaccgcatccatgccaacatcgattattttttgatttttttgattatggccattcttgcaggagtagagtggtattacattgtggttttgatttgcacttccctgataattagtgacgatgagtatttttccatatgtttgttgaccatttgtctatcttcttttgagaattgtctgttcacgtccttcacccgctttttgatgaaattgtttttttcttgcagttctttgtagattctggatattagtcatttgctggatatatagattgtgaagattttctcctgctctgtgggttgtccatttactctgctgattatttcttttgctgtgcagaagccatttagtttaattaagtcccaatatatttatctttgttttcgttgcatttgcttttgggttcttggtcatgaagtatttgcctaagccaatgtatagaagggtttttctgatgttatttttctagactcgttatggtctcagggcttagatttaagtcttttatccaccttgagttgatttttgtataaggtgagagatgaggatccagtttcattcttcaacatgtgggttgccaattatcccaacatcatttgttgaatagggtgtcctttccccactttatgtttttgtttgctttgttgaagatcagttggctgtaaatatttggttttatttctgggttctttattctgttcgattggtctatgtgcctatttttataccagtaccatgctattttggtgactatgtccttatagtatagtttgaagtcggataatgtgatgcctccagatttgttctttttgcttagtcttgctttgactgtgtgggttattttttggttccatatgaattttaggattttttttttagttctgtgaagagtaatggtggtgttttgatgggaattgcattgaattgcagattgcttttggcagtatggtcattttcacaatattgattctacccatccgtgagcatggcatgtgtttcctttgtttgcgtcatctgtgatttcttttaacagtgttttgtagttttccttgtagaggtggttcacctccttgtttaggtatattcctaagtattttattttattttttgtagctattgtgaaaggggttgtgttcttgatttgactctcagcttggtcactgttggtgtatagcagagctactgatttgtgtacatgaattttgtatcctgaaactttgctgaatttatttatcagttctaggagctttttggatgagtctttagggttttctaggtatatgatattatcatcaacaaacagcaacagtttgatttcctctttactgatttggatgcccttcatttctttatcttgtttgattgctctgactaggacttccagtactacattgaatagtagtggtgaaagtgggcatccttatcttgttccagttctcagaggaaatgctttcaacttttccctgttcagtataatgttggctgtgggtttgccatatacggctcagaccatagtgaaataaaattggaaatcaactacaaaaagaacactcaaaaccatgcaaatacatggaaattaaataacatgctcctgaatggttgttgggtcaagaatgaaatcaaggtggaaactaactgaactgaatgataatagtgatacaacctatcaaaacctttgggatattgcaaaagcgatgctaagaagaaagttcacaacgttaaatatctacatcaaaaagtttgaaagagcacaaatagacaaccaagggtcacacgtcatggaactggagaaacaagaacaatagaaacccaaacctagcagaagaaaagaaataacaaagatgagagaataactaaatgaaattgaaacaaaaaagtacatttaagtctttactccatcttgagttaagttttatataaggtttaaggaaggagtccagtttcaattttctgcatatggctagccagttttcctggtaccatttattaaatagggaaccctttccccattgcttatttttgtcaggtttgtcgaagatcagatggttatagatgtgtggtcttatttctgagatctctattctgttccattggtttatgtgtctgtttttgctccagtaccatgctgttttggttactgtagctttgtagtatagtttgaagtcaggtagcatgatgcctccagttttgtttctttctcttaggattgtcttgactatacaggctcttttttttggttccatatgaattttaaagtagatttatctaattctgtgaagagtgccaatggtagtttaatgggaatagcattgaatctataaattacttagagcagtgtggccattttcatgatattgattcttcctatccatgaccatggaatgtttttctatttgtttgtgtcctctcttatttccttgagcagtggtttgtagttctccttgtagaggtccttcatccttcacttcccttgttagctgtattcttagacattttattctctttgtggcaattgtgaatgggagttcattcacgatttggctctctgcttgtttcctgttggtgtataggaatgcttgtgatttttgcacattgattttgtaacctgagacttggctgaagttgcttattagctttaggaacttttgggctgagacgatggggttttctagatataggatcatgtcatctgcaaaaagagacagtttgacttcctctttttctatttgaatacgctttatttctttctcttgtctatttggcctggccagaacttccaatacagtgttgaataggagtggtgagagagggcatccttgtcctgtgccagtttttaaggggaatgcttccagcttttgtccattcagtatgatattggcgacgggtttgtcatgaatggctcttttataaaaatttaatttaattttaagttccaggatacaagtgctcatgaaaatcaaataccaagcttgaggaggcaatgtccttcccagggcccttcacagggctgaatttgcaagcaagcagatttacctttccactggtccaccttctttctcctaccatctgatttgttcttcctcaagtacgcatgctgtggtaaccttgggttttttctctttttggtagtatatgcggatgatgggagtgcatccagtgatccatttcctggcctggttcctggagaacatggctgtgttgaccataagcagtgctactctggccatcgttctgaaaacaagtggcatctttgcacacagcaatacctttattgttttcctctttctcttggattttgggatgtcagtcgtcatgctgagctacctcttgagtgcatttttcagccaagctaatacagcggccctttgtaccagcctggtgtacatgatcagctttctgccctacatagttctattggttctacataaccaattaagttttgttaatcagacatttctggtaagtaagttgttttgtaaaaaaaaaaaaaaaaaacaacaaaattgcaatctatctaacaagacaaaatcccaccactctcactttttcaatttgtcatgttcatatctacatgggctttctgatatctgctttttaaaatcttacccacaaatgcaaaccgttgaaactgcagggtttttgctggacagcagcccattaagaatgtccagtttttacataacagagactttctgcagattctggaaaataagcaacattcttaaggaagcatataactttattttctctttcatgcacagaaaaaagctagatttctaaagcaattttagaagtaaaaaataagcattttttcttgaaacattatgaattacatcacattaagtggaaaaatctctctgttagcaatgtcagagtcactcatccatttaaaatgtacctcctaaaaacgtatgataacactttcaggtctgtaacatcaaatacgtagaacataaaaaagtattcattcttttatggcaattgctggcaagcgcagtgcctgacacatagtaggaactcaatcaaagcgagggtgaaccatcactattaaaatgatctgtttcagagagccagtggcatcactataaacacttgcactgtgctcaagactttattctctccagcaggtcaagtgacttcctaaaattgcagtctgttgagagataagacagagtcattaacagagactttggggaggtgtcaaggagacctagattacggggctgctcaggggtatttaaaggcccttaaaagtcctttagtccagcacaggattcatgacggccccagtgcttcactcacttattgggagcaaaacaccttctctgctcatttagggcctagagtaaaatatttctatgaaagccaagtgatttgtcttcaacttcagtaaacgattcaaagctgtctggtttctactagccatatgctcacaacaaagatatacatacagaatgaaaaagtggttatattccatcagtgttttatctattggtatgtgttcattggtcttgattagcttatgttacatttgtaaaaacccataaccaataacttcctgttagtgttaattagctgttttcagaataattaacacaagtgggaccattggtggtccttccccatatactccttgtacatagaaaaagagtcatccatgatctgacctgattttcagatggtgttatttttaattttacttcagtcattatattcgtgggttctgtgcacataaaatttgattttctgtttacatattcaaatgctttctagcaagtaaaaaatatctaactctggtacactgtattttttaatgtaagatatttttttcaatggggtttcgttctaacataagacttctccactgagatacaataacatttttcttcaatacaccttctttctagtgtagaatagtgtatgcattccatcagtcagcctgcagtgtgctccagggcattcacttaataataaaaaatagtaaattactctattccagttttcactgttttgtgttacacatttctgtgtatgatacattggatttatgacacttcaagcatctcggtaaagagaaataattccttttaacgttaaaaactagcttgttatcatgcttttcagagtgggctgacattccgctaagattttcagatcaaaatatttaaatgactgcctgaagcgatggttgggcgtcatcagaatgaaaagttgtcatggcttcgctccttgaattaagtgttgtggattttctgtggtcccaatcaaaacactaacgtgcagtttttctccatcaatctgtgggcagtgccttctttcgacaaccgcctttggacaaggggtattttttattacattcctggaaggacaagagacaggtaagagcatgcatgtgtaaaaagtgactctcagtgaatcacgtttttggaaattaatagttatattgcaagtgatccagtaggaagtcttcattatcaagtagagcattcagaatgaggtttggatatttgctttcactgttgtatacacctcccactatctggtagcaccagttttgagaacaatcaagaataatcatggcatcccttgcttcagacactatccaggtcaaccacccagccaatgcttgggtcttccttataccacccttgacgtctggtctggtgagtgaccttctgaaccttccaagatagggtgtgcaaatgtgtccatctgttagatcaggggtccccaacccctgggccatggagcagtccgtggcctgttgggaactgagccttacagcaggaggtgagcagcaggcaagggagagaagctttgtctgtatttacagccactctccattgctcacgttatcgcctgagctccacctcctgtcaggtcagtggggccattagattctcataggagcctgaacgttatgtgaactgtgcatgcaaaagatctaggctgcatgttccttatgagaatttaatgcctgatgatctgtcactgtctcgcatcacccccaggtgggactgtctagttgtaggaaaacaagctcagggctccccgtgattctacattatggtgagttgtataattattttattatatattacaatgtaataataataggaaaaaatgcacaataaatgtaatgcacttgaatcatcctggaaccatcctctatcccccggtctgtggaaaaattgtcttccacgaaactggtccctggtaccaaaaaggttagtgaccactgtgttagatgattgttgacctgggatctgtcttcctggatcctctacccatgttttctagttcttcctttctaattatccctttcacatgaccaccatctacatatttgttggctctcatctttactcctagatttactagattgttcctgaagatcaagatccagaaataggtctaataagcataaaatagagtgcaattatctcataccaatgcaggctaaaatgattttctaaaaatctattggcagcattttttgcttatattgagaatttgacaactaaaattctaaaccagaacagacatatatttcatagatatttgtatggttttttttgggggggggtgtttttgtaaacagaggtaaaaccatgctataagtaaaatttgactctagctattgttgtattagccagttaatttgtactggtctttgagttcttagagtttttcaataagatgtattaaaatgttcttttacagatgagtaatcttgaatgatttcttctaactgatctttagaataaattgaatcaaaatgatagaaacaaaaaatggaaactgttagaccatttgaatattttggtctaaattccaagtacacaatgattaaaatgtatattttattgaactgtagcctggtaccatagggaaatttagaaaggggaatatttttcttaagttgtatgttaatccagaaataaatcacaaacctattgtaaaaaaataataataatttcccaccctagttcttatatatcctattatatattttccaagagcacagagagttacacagtttagaatttgggttctcaaggagactttaaaaaatttttttgaatgcttattttccttaaatataaagtcctttctactcaggtaaataaaaccagatatgagtaaggtgacctttaaaactttttaaagtattagatattaaaaagtagttaacaatccccccacctgatatcattgaaataggtgtaagattgcacaagttaacatttcatgaaaagttatggccagtgatattgaccttctttttgttttagttctgttcaacttcacttgagcttccagaagtaatgaactcatcatgacaaaatctaccataaaagagcttgtgcagttctaactctgacctttttcttcctgctagggattcaatggaataatatgtaccaggctctggaacaagggggcatgacatttggctgggtttgctggatgattctttttgattcaagcctttattttttgtgtggatggtacttgagcaacttgattcctggtaagaattttgccttttgtaagataacacaataaattttaaaaacagtttgaattaatatgcataaatattagaataatcacttattctttaaggaagatccagaaagggaagtcttaggatatatatttaaaaggagctgtacatttttgagaaaaaatgtgatgcctttgtttcccaagtgaaaggtaaaaggccatgtgagggaatagccaggatgaaattagcatgaaaactcaccaggcccaccaagcagctccccaaaagtgggcttcagtctacacagaaaatatcctggtttctcagagagtgtttggggagggcaggcatgagggggtgagggtgggggtgctcagagtgccttggccagaaagtcactcctagtggggatctagggaccaagcgctcagccagtggcaggtcggtgcatggcaggacctggggagaagcaggcagagcctaaaggcagctggacagggtgggctgggagtgaggggccatgtccaaccacagggctttcactgttgtcacggatatggggtttcccaaatgtggtggtgcccttcttccctggtgtggcaggcatgccccagagtctggaggacaagtatatcaatggccaaaaaaaaaaaaaaaggccagtaatggtaatgggttttcctagctgttttgggaggaaaagaggcacgcatacctttacctttttggttcaggcccgaaagagcagaaatagcactttaaaattacttattttattttttagagataacactttgatggtggtgtattttcttgctgaaattacttggcaactctggttctatgcttttcaaagcaaatagtgtctaactaaattaaaactaaaaattaaaaaaaatgattctaatcttatacaaatgaaaatggagggatagaaagaaaacaaatgcagttcattctgtttgtgaaaacacattccagacttggagagctcatgaatcatttagggatgggtaaacataaaaataatatgggccactgaaaagatcattttacacaaaagtaggaatatatggccctcaagaggtagagagagaacataaattggaaatgtgatttatttaggaaaaacttagactgcattgtcttggtactttgaataaaatttaagaaaataaaacttaagaaataagattctaggaaataaaggataaaacaaatgagttgagaaggccaagggttcaaggaaattggatgagaagcaattgactattgagaagaagcaaaaataacataagaaagtaatgttacaaaatacatttgtgatgtccatctaaaatacaaagaccagcaacaaagtctactctctgcaatgttgagatgaagataaaatgtgtcccgggacccagaatgatctgatttctccctcaaccatcagcatctaaggctagaggctcttggggcaatatttttctacattatggtaaagcaaaggaacattgtattcagctgagactttccctctgaatcccactgtggaattctaaattgaaaagttttaaaagagactgagccttgaggtggatgtctggtgtgcagagggctcactgtctaggtcatatttgaagggaagaaaagggaattgggagtagactcatggaggaaggtaattgaactcagaaaagctgagtgatggtgagaatgtcctcaccagtgggacagtattgagtcgttccttatcctgtgggtcaggggatgtttggctaagctggtggcttttaagaagaaattctttctaaagttcaatgaggtcaacttgaggctcagaggaaattaaaaaaaattgttttcctcaggggaccaggagattcaaatgctagagttggtaatcttttggaagtaccttggccatctgaaccatgccacatttggaactcacgtatattcgactgaggaaaccgtgatctcctgttccttctttcatctcctcctgtccttccattccttcagactcctaattccctgccctcccattaggtgaaggttaaacaaacaatccaccatcttcatacactcacactgcaatcctgcagtctcacaatatggctcatgattaacatctacccaatatgttaaacttgagctatttcagaatcagctcttaccctgccacatccaactggagaaaaagatctgctgattttacttcacaagtctcccttaagttcacacggatgtaccttttctagggaatgtctccatgttttcatcaagccatacaaagtattctgtgacctctaatgagttatgattcccagatacactggatcctacaccctgcaaagggaagcaaatgcagtaggacctcaatccacctttgaatggcagacactcatttcaacattttgtttagtgaatttagagtgggaggttttatattttctctttgtgattgtgacactaattttagctaccagctagttaggaaaaaagatcagagtctattacagaatttaaaaaaaatcaaagctcgcacatatttataacacatatttaaaaatacaaaggcatagagctgaataaatatgtcaataaatatttttgactttatcacaaaattcagattcttttatttcaaaagctaaaaataagagttggcaatttgcatattcttaaattgcacaaagtatttcttttccactttgacaaagtctgccaataataacaaagaatataattgccagacactactgatgggctttcagatccataaagagggttataatttctaggaggtctcagacccaataccttctttttaagagaaatattttatattacctcctttactctcttgaaatgaaacttatggataatgaaaactacctgcatatgagtcttaaaattaatgtaatttaaaaattttaatataaaagagaaatagaaactaatttatagtaagttctcggtgctcaggcatgaatgcatcggaacacagaatgagatattcagttgcttatgcttatgtggaataagttcggatttaaaagaaggagaaaggtcagaagccatttggcactaaaaggaaagaaaatgcataagtaaagagaaatgtagatactagaagtaaagctaatattaagtagtactagatcagacttattggtatgtgattataaagatgaaaataacttcagttgaagtaggaaaaacgtgggaagaaatattatacatgaatgaagtgaataaaagaatgatatttttgtaaatgacctgggtctttatttaaaagtaatcaggaaattccctttgttaacacatggggcaggtaatgacaaaacataacagaagatccattttctgtcttacaattctatctcatttcagtttctccattcagcctccagtctttaaagacgttggagatctattctttagtagtgacaggaaatagaggactgattggacaaaggaataatattaataatataagagggttttatagagaagccaaggggtgaatatctgggaacagcatcaaaataagattgaaaactaatagggagcctcatgttaatcatctcaatgtgtaattttcaccaaatggtcttattgtgctatacagttttaaaatatatatatcaaatgacaatgtaacatagttactaacccttattaatacaatttagtgcattttctaaatttctactattcaagaatatctggttttaagtttgttaaaagcaatcttcacatcttttgtcatgtgtttgtatataatggggcagaatgaagattgatacagacatactgcattgcaaactcaaacgcagtgagtgacatcactattgatggcgttgttttccaaaacaatggacaatttctgctttaaaaaataatcttccactagtttacacagtggttgaatttctgaaaaatttagtgtatactgaaactgcacggaaactttgagtttatatgtcctaggctcaataaccatgaaacactttgcatttgcacggctgtgtgtgatcaggctcacagaaggcaagtcaaggacatttctttgttgcactttgtagggtatcaactaacccaggcatctgcacactaaaggcaattgtaccatccccattgtattaatcatacttttttattttctgtatttttgaggctttgactggggttgaaggagtgcagttactgaccctagagggactgttccttccagggatagccagttcctagccatagtaaaggactcacctgtggatgtgcctttcacaagcaaaaaaccaatccagagcccacgcccctaccacctgctgtacggggcgatcacactcggggtcactgtccacctggcctgatcagcccagggcaaggtaccagccaactagggacagactctctcccgaagagcctgatgaaattattcacagtagttaattagaaatgtacttgcccttcctcacatgttccttcccttgaaaaccacagtaaaggctcttgttcacattcccacagcacccctccctacttcccctgtctcctgactgacactggtgcttccctgtgtgaccctgtgtggtgtgtcatgcctccttctcttggggtctgtgagtaacaaagtgtagtttcaatgacagttatctcctgatttgttggcatcatcatacttgagtaataataaaatctatattttaaaacactgttccagagtctcctgtgggtaggagggtgtctccagatgggaggtaggaggcaggaggcaggtgagaaatttctctcttttgctctctgtcacacacatacacatacacacacacacacacacacgcacgcacacaccccatacctcagacaaatacttttctctcgattttctttctttgttataaagtgaccctgtgagtatgaccccagcatttctcagccccggtgtctgactgggagactctgtagatccagcatcagatcatttcctggcctgcggggctcagcgtcaactgcaggtctccacgctcgagtcaagagctcacaagcaaacatctggtcctctcgaagagttttcattgcataaactctttttatatgcttccaattaaatttgattctgctcgatctgtctaatttcattgacctcttcttttatcactgtcagttttggggggcaatgctgattagtttcctggcctgcataagccagcaggcagttccccttgaggagaaaagctctgtgtaaatggagggcctttgcacatattaatgtgcccaattacatctggtaatgtgagcaggttgtatgtgcttctagagtgtgcacgtaaaacaaatttgaatttataagcaaaagccgattgcagaggcaagccaaagagctgagcggcttccacgccagcttgcatttggcagctctctgctttagttagattagtagattaattagggggttttaaaagtccagacagattatggctgagatggtttaattagcaaagcaacccttaatattcaatttattttttcataactctggaatgtctttcacgtttgtttctacttcccatccctgaagccattaccttagttcaggcctcactgtgcctgatctggacttacagcgagttacagtgcctttgtaactccttcctactcctctaggtatccccgaccccagcacctcacctctgcatcctacctgcatgttgacacaaagttatctttcttaaaaatagaccaaatagaccatgtccctcccctgcatgacagtcttccccaactccaaaatgtctagagaataaataatatcctcagtggctctcaggccacccgaacctgctctgctgcagattcacgcccctctctctattcccgttgtgctgatggggagttggggggcagtcttcaatgtgcccagcacacccacacagggtaggcagataaaatacagggcacccaggtgaattcaaatttcagataaactacaaataatttgggggacatattcatactaaaacattaattgttgtttgtctgaatttcaaaattaattgaacatcctgtgtttgtattttctgaatctagcatccctcccagcatctctgtcttttcattctcattcctttttcttgggttgaagggcctgcttttgttttgcataggtggaaacctatgatgacaatatcatcttgtattcttctctcaatgattttttttttttttggtcatctgtactagaatgaaggtcataagaaggcgcagtctctgcctgattcattggcgtgtccctcgtaccactagagggtgtgactagttgatttctgtttgatgactgacatcttcctggaacaggaaggtataatccggagaacagaagggcaagggatatgatgttccagatctaggtgacttctgccctgctcctttgtcactgtgctgaggcctcacctgtcctactcattcttgggctgacagctggaactgtgagccctgggagatgagccagcatctctcctcatacctctgtacaaaatgcttagttattcatttctcaacaaagcatctcccacagtaaatcagggctgcaggaaggtgtcatttcccaaagactcaagtgagaaaacaaggatacaactaataaagagtaatgtcttagctccattgcaagaaactggtgactcctgacattgttgcagttgtctatgtgtgcacacttgtgtctgtgtacatgtacatgtgtgcatgtgctgcatgaatatgtgcatgtgtacatgtgtactcgtgtgtgaatgcctgtgtgtgtgcatatgtatgtgggtatacgtatgtgtgtgcacacacacacgtatggtgatcttcactttgagtcatggccctaagtttgaaatcatatttatctttgtacgacttccacttatatcgaagtgaagcagagctgaggcttgcttcaggatttccttgcgtacactcaaaatgtgaaggtgttcaatgacttcatttggaacaggcaaattgtgccttatttcacctttagaatgtgcatgtatgaaatattcttttctcccctatggttctgaaaaattgagctataatacatcagatggatatgtgtttattgtaaaatgtttgaaaagtttatagagaagcaggaaaaatttttgaggaagcaggaaaaaattcagttatctccaatatcaccaaccagaactaacatttcccaggctttttccagacagttttctgcacctagttgggttcacactgtatatgtaaatttccctctgttttaaaaaaatatttttatcataagcatttatccacatctttgaaagtactgttaatggctgctcaacatttcattaaatgaaagtaataacttcctggacctttctcctactttgcaagtttaaataatttctgctttttccccactataagtaatgctacagtgaatatatttatgttcagatgtgtgtccccactttgtcattgtgtcatctagaatcctagaattttaattgctaattcaaatctataaacacttgaaggcatctggatcccattgcctactatccttgctaagggtggtgcccacttaagctgcgactgagtgtggttgcctgagaggcctctgagccgaagacctgcagctttgtgagaataatcttcctgatgtgtttgcttgctttctgtctcctttgatttccacacactcattgttcacgtatgtgtcaacaggggcttttcgtgtaattggtactggaagaaactgtgcttctttcttgttgtaaaaggcaacccaaagcatcctcatgactgcacttgcgtgttcagacaggcaggagctgctagaggagaggctaaccagtgtgtagcttctggagccatcagctgcgcgtcactgggcaacccttgctgttcctccttttcttattgggaaggtagaggtgataattttacctgacatgttggtggtcacaggactgtgtgaattaatacaaccagataccctggacagtgcctggaacacagtgagtggaatgctggctgtgatatgacctgattatccagctgctactcatcctcttcctacagagggatggtttttgctttgcaaggttcttggaggacacctgcctgcattaattttctcagcctgccataacaaagtaccacaaactgggtggctcaaacaacaggaatgtgttgtctcacaatcctggaggctaaaagtctgagatcaaggtgtaggcctgtgtatgtgggtatatatatggactggtttctcccaaggccactctccttggcttgcagatggcattgtctccttgtgtcattcctgtgtatctgtgtccaaattttcttttatgaggacaccactcacattggattagtcctcgctcttgtgacttcattttgccttcattacctctttgaagaccgtgtctccaaatacagtcacattttgaagtacagggggttagaacttcaacatatgaaacctgcggagatacaactcagcccacaaagaaaagtcagtgctattcctcacagcagctgaacagcttcccttcactttatgtatttatttttttgtaacttttaagtgcaggggtacatgtgcaggtttgttacataggtaaatgtgtgtcatggaggtttattgtacagattattttgtcacccacgtattgagcctagtacccatcagttattttttctgatcctctcccttctctcacccttcaccctccaaaaggccccagtgcatgttgttccccgcagtgcatgttgttcatgtgttctcatcattcagctcccacttataagtgagaacatgcagtatttggttttctgttcctttgctaacgatgttagtttgctaaggataatggcctccagcttcatccatgtccctgcaaaggacatgatctcattcctttttatggctgcatagtagtagtccatggtgtatatgtaccacattttctttatccagtctattgttgatggccatttaggttgattccatgtctttgctattatgaatagtgccacaaagaacatacatgggcatgtgtctttataataagatgatatatattcctttgggtatatactcagtaatgggattactgggtcaaatggtatttctatctttaggtctttgaggaaccaccacctgtcttccacaatagttgaactaatttacactcccaccaacagtgtataagcattcctttttattcacaacctcaccagcatctgttattttttgaccttttaataatagacattctgactggtgtgagatggtatctcattgtggtttcgatttgcatttctctaattatcattgatgttgaggtttttccatatgattatcagccccatgtatgtcttcttttgagaagtgtctctttatatcccttgcccactttctaatggagtgtttgttttttgcttaatttatttaagttccttatagatgctggatactagacctttgtcagatgcatagttaagcattcctatacagcaacaacagtcaagcccagagttaaatcagtaacaaacttccattcacaactgccatacacacacaaaatatctaggaatacacctaacaaggtgaaagatctctacaaggagaactacaaaccactgctcacagaaatcagagatgacaagaacaaatggaaaacgtttcatgctcatggacaggaagaatcaatatcattaaaatagccatactgcccaaagcagtttgtagattcattgctattctcattaaactaccattgatattcttcacagaactagaaaaaaatgtttcaaaattcacatggaactaaaaaggagcccgaatagccaagacaatcctgagcgaaaagaacaaagctggagacatcacattacctgacttcaaactatgctacagggctacagtaaccataacagcatggttctggtacaagaacagacacatagactaacagaacagaatagagaacccagaaataagaatgcacacctacaactatgtgatcttcaacaaacctaaaaaacaagcaatggggaaaggattttatatttaataaatggtatggggataactggctagatatatgcagaaaattgaaactgaaccccttccttattgccatatacaaaaattaattcaagatggattaaagacttaaatgtaaaacccaaaactataaaaaccctggaagacaacctagttaatacaatttaggacatagtcacggacaaagatttcatgacaaagatgccaaaagcaattgcaacaaaagcaaaaattgactaatgggatctaactaaagagcttctgcacagcaaaagaaactattgacagagtaaacagacatgtctcccattctgtagaattggaggaaaattttgcagaccttccctttactttcaaaaggtaatggatacatgtgctctcctttgagtgcatgaacatctctttctattttttgattagaatgtgcgagggcttgcatatctctcttctgcttgatgatcaaagtgctataatagtctttatatcagcctttttaattctaatcagttgtagaatttaggcctttaggtaagttacgttcatcaaacttaaactagaatggatgtgttaaaagaaaattgggaaatgttaataatgaaatcccttttcatttcaacatgtaatgagggcaaagtgactgttaaatgggctgaaatgaatttggagaatacttttgaagaatggtaacgtgtttcatatggaaatgttagcattatgaattattcttctttatggaaatttcaattgattaatcccctcctacacttacctcatgctcttcctcttgtctaggaatccatgcaaacatcaaagataggcaaaagaagaacaatcacaaaatagaagggcagtgtggggcagggtgggactttactctgggaatattcagcaattatccaaaaagcatgtattgaacccctactctaaagataaagtcttgggggaagtggctgagagggggttttagcacatggctgtggatcaggccgagaagggagagttagggctccactgcaaaactaatagctgtgccctgggatatcacattttgtatatgggacatatattaaaaatattaacatgggatgacattttatattaattacttaagatattctaatacagtaccttcatctaaataaaaaattaaactaattttaattgtttcattttttaggaacatttggtttacggaaaccatggtatttcccctttactgcctcatattggaagagtgtgggtttcttggtggagaaaaggcaatactttctaagttctagtctgttcttcttcaatgagaactttgacaataaaggtttgtaaggagtagaattattagatgcatgtatttttcctttgatccattttgatttttttttgtttgtttttatggtccagccttttcaagtgtgtgctgattcctagagagacttacatttaggctgtcttgggctgggaaacagctgcaagcccaagatgtgggaaagtatgccatgacagtgtttgttctgtgaaacccaggaaacccagggagttcccattaattattatttagcgtcctcccctctgtgcattatgtgcatttgtgtgtatattacaatttagaaaaattgaagcgttagtcccaaaatgaatatgtgtaagaaataaaagcaaatatgggcagctaccctgtgtaaagcatttaaaaatttttaagtgttctcacccatgctggtttattcagtgttcctgtgtgagggagaatatcactgtcccttacaaatagggattgtggttctcaggagataggggcaggactgtccctgtgcctctgcactccagagtcatggcctgttcctgcaggtgcaggcacagggcacctctgccaaaggatgaatccataggccatctccatggaaatagagatgcatcactcagagataaacaagctcccatcgtggtgggtttagattacaagtcaacattctaatctaaacaatctaaatatttttctgaattatgaatcttttagaaaatgtggaacacatcaacaagcacctatccactctcacgtcctcaggagactatttctcatgaacattttatgtgtaactaatctgcctgttgtttttttctctacttaaacaaaaatacatgtgtgtgtttttattttttttattttttacaaaatggttatcataagggttcaaaactttgtaatcagtgatatcacttaatgtttgccattatatagtctgcttcttgttcttgctaaagaaagatttttgagttgatttgtgtgcttcacagagctggaattcaatttcaaagcagaatgctgaattaataaatatgagcattatttttagggcttttgaagtcttttcacaatgaattttcatctctctcacagggtcatcactgcaaaacagggaaggagagcttgaaggaagtgccccgggagtcaccctggtgtctgtgaccaaggaatatgagggccacaaggctgtggtccaagacctcagcctgaccttctacagagaccaaatcaccgccctgctggggacaaacggtgccgggaaaaccactatcatgtgggtcccattttacccttatcaaacactgggcatttgattcttaaaacttcagtttacctgtgagacagaaggtttgatttcttttcctttttttaaaattttgagtctcaatacagagtttagagacacgggtgaaaggcagagcccctcatgagtgcccgtgtgagagaggccctatgtcttcaaccgcacaggtgcactgtaggcctggggctcagtcaaaggggtagtggtggatagctttttaaaaggcttaattcttgtattttctacaaataatttaccatgttgtactttagtctttgaaagtcctttggcactttcagcgtttgtcctactaagtatcatcttgcttgcatatctgtaggaagaggaatatcacagtggtacttgcaaattttttaaacacctgattatttttcttttccatgttctggtttttgtgtggttcttttctcattaagggtagatgtttggtttaggattcaatggctctagatttgattaaagaatcaaatcatgtgctcccagagaaacaatgaattcaaacattcacagccttgggctggctgtagaagtggaggtttaaggttaaactactaaaattatgaaatatctcttttgaacaaatcactttctcttttgttctttttctcactaaatatgtagtattaaagtgtgattagttaaaacaatgaagagggctttgcctcagacttaataagaaaggtagaaaaataacacatgaaacttcagaaatctcatactgaaaaaatagaaagaaagaatatggacagtttttatttgttccttggatacagaaatggacctggaaaagcgtgtgagtgttttttttagtgtttgaaaattgggaaaccacaagttgcacaaataatgactcagccagccagttcctctcaccctgcttttactaagacacatttcttacaaggaaaacctgggctgcttgtttagcagaatgatgagaattgcatttggagtttctagatgatttaaagttcaatgactgtgttgcttttagtgtacatttgtagtacattttgagtcatcctaagtggctgcctccacctggcaattcttagatgaaaggctgagaggtcagtcaaagacgggggggtcttcactatttaaaacaacagtctttgagacttctagggaatgtgtataaactattttatagtatcccccagataggtttgaaaataatatagcaaagagttttaagttcatcgaggtttaatttttgtgcagtaaacagtatctgttgatgtgtacagtttgatgagttttgacacatttggttagtgccggaacaagcaccacaaatacagaacctttctatgctgctccaaggtttcctgtgctctcctttgaccctggccttcatgtgaccactgatctgctctttgtcactaaaaactaggttacttattctagaatttcttgtaaatgggatcatgtctggcttcttgtactcagcagactgttttggggacccaggcatggtggtggtggcccagcagcctgctccttgggacagctgagtggtatccaccatatggaggcaacccagcttctttatgttttcatccatgggttgcaactgaggttgtttctctttgtcagtgattgtgaacacagctgctgtgaacatttgtgcatacagctttgtgtcggcacacatttaatttctcatgtgtaaatactaaggagtggatttgctaggtcctgtgtggtaggggcatgtttaacttttcagaaataagaaaccaatttaaaacttaaataataaacttcctgaaacaaggaagcagaactaggcaattctgaggcttctgttggtaaagtcggtcatgtgagcttgtggtggcaggctgcttgatttcttgtggttttaacacacacagactatcccgggagcagcggaaagaagactggctccagggttggggcctagctttgtatctctgttttgcttatatttaatgatgaggatttaggtatatatgtcatttctttagcatgtttcctcatctgtaaaaagttgaatgttatcatcttaaagtcccatacaactataatgctctatgattgcagttcagacttacaatggttcaacttaatgatattttgactttatgatggtgtgaaagtgatacatattaggtagaaaccatagtctgaggactcatacagccattctgctttttactttcagtacaatattcaataaattgcaagagatattcaacaccttattataaaatacgctttgtgatagatgattttgcccagctgtaggctaatgtaaatgttttgggtacacttaaggtaggctagactaagctgtgatgttaggtaggttagatgtaaatagatttttgacttacaatattttcaactttttatgggtttattgggacataacccaatcagaagtcaaggagcatttttatttcatgtggtagcataacatgttaaactcacattttcaacatcaaccagccaatgtaccctcaaactactcacaccttttaactgattgtgtaaaaaccaggtcagcagaaggtgagtgctcttggcaggatgcatgcgccatcctggagctgactggattgctgacgttcacagtatcagcaacgcgtattctccatgctgtcttattttctctggcagatccatgttgacggggctccaccctcccacttctggaaccatcatcatcaatggcaagaacctacagacagacctgtcgagggtcagaatggagcttggtgtgtgtccgcagcaggacatcctgttggacaacctcaccgtccgggaacatttgctgctctttgcttccataaaggcgcctcagtggaccaagaaggagctgcatcagcaagtcaatcagttagtaaacagttgtctctctgctcctcctgcctctgcccattgtgtaaggaagtgaagacaatagaaagagacacttaaaaaatcatctgtgtctacatttataagatgaaataattagcaaatggttgttaactatggaattatgacacagccaccaacactgagaatgtcagaaaaggcttctgtgggaaggcattgaatttgatttgatttgtctttgaaatgtggaagagatgagcacatgtaagcacagaggctgttgatggaaactttgtgtatctggagtaaaaggtccctaggggtgtcctgaaatgaaaagaattcaaaggcagcgggaaaactggttgtcaagaagctgattagtctgccttttctctccttgatccctagctcttcctcaactccttccttccttcctgtcacacacacacacaaagattaagaaaaaaagagccttattagtcatgctaaggagtttgaacttcactgagcaagtaggtgttcatgagtgggggactgtgattagcctgagatctggaagatctctcctgctagatcatagcaggtgccatgggagagactagatacagagtggccagtgtaggcaagaggtggtgacagcctgatttatggtcatgccactggggtgcatgggccaggaaggcctgtatttgaagactattcaaatttagaagaatcaggtcatgttgactaactggttgcacaaggcagggagcagagaactcccggtagggtcacaaacaattggtaggacattggttggtccacatggggggctgaaccctatatgaaagtggaatagcacaaggaagatctagagttgagaatatgtggggagaagtggaaaggaagtagggtatccaggatgggaagcaaggcaaaatccaggcagtgtgccctggctcattggacattgatagaagtttagaccagaggtaaaagggagagacagtaggttcctgattagagaacaaagtggtgtttgagggtgatgaccatggaagcatggattggaggggaagtggagcaatgaaagtcatggagagtagctggagatagaaacattaatccagtgctggggtcatcgattcagcaaacagtggtagttaagtgtgcaggccgtctgtcctgtgctgggctctgccccctcaggaagatgcatggctctggcctcctggggctagtgctgcatgcttggcaattccaatggatggactttgcaaagcagaacgtcaaccatggcgtgagtgtgtggggaaggggcccttggaggcaagcatgtaagtataactggtaatggactgcacattcctaagaagaaaatgtgaatgtcatgaattcttacagaatattgttattttacaatatttttgcaagctttacatttataaataagtatttacaatctgcatttaattaaggtgaaagctcacagggtttgggtgttgttttgtatggtgtaaccttatttctttaccactttttccgctatgtgcttcatgatggtggagctctaccttggtgtttctagccctggaacactgagaaaaagaagaatgagtcttaaagttgtcacacattccatgtgccgttggcgatatgaccagagaccaagtaaaacgtttgcaatgagaatgctccattccacccttccttttacttggcctctccaggtgccattgcttgcttctccatccctgccattgcaggtcacccctgcatcatgcctctgtagagatgccagggctgcagctggccttcctgcctgctgtcggcttcttctaccctttcctccagcccctttggctcacttctgcaaagcttatcttgtccccaaacccaacccccagctgttctccccagatcatggtctagcttcctgatgtcacgtgctttcagtactccacatggagtgctccttagaaatgtacccaggtcctggcccttctctgccaactgcccttcaaggactcacatcacttgaggtataatctaaaggtatggaggcctacaattgtgtaatttacattcttgtgcctattgtctcagatttattatgagtgcccccttccacctcaaaaccctcctcctttggaatataaatttataaagccctgccagcctctcttgctttacctgatccttcattgtgtggtgcctgctgcgctggtcttatggtggatccctgagcacactgaacaggcccttcgctgcgttcgtgttgtgatgggctccgtgtgtagcctgcctcactgccgtcctggctcttctcagacaccatcttaccagagcagacttcctgagcattctgtccagaacaacttcccactcactctcctgagtcccctctatttctctggctcttatttacgacatttatcatttcatgacagcctctgtgtattagtcttctgtttctttccaccagatagcaaaccccttgactacagggacgtagtctgtttggttcactatagtataataagcattctttgagttgaataactggatttttttttcaatttttatttttatattttttccataagttattggggtacaggtggtatttggttacatgagtaagttctttagtggtgatttgtgagattttggtgcacccatcgcttgagcagtatatactgcaccatatttgttttattttatccctcaacccccttgagttcagaaagaaacctcaggtgcaaacaatgaagctgaataagctctactggggggtgtgtgaagtgggtgcagggggtcagctgcccttggttgtatggtgaagggtcatagcagaggtaatgattgagcagcaggctacaggatgagtaaggatgaactggggttgactgcagtgggtgggctgcaatatgttacagcatgtgcagcttagagcgtccacaggcctctctcttgcaggcctgtgcacaggcacattacagaagcttcctaagccttgcaagattttaggttttgttccttaggctgtccatgggcatgaggcctctggagagtgctgagcacctgatacgatggccgtctaatgatggttcacacactctctccagttgcaggtggaggatggggtgggctggggtgagcccaagtcgcagggagagctgggggctcctgcactaagaacagattaggccaggagaggtccagtagggtgaggaggaaagggagatgcagacccaatggggaataagagaggagggggcgtccatggtattccccagatgtctggctcaggcaagcacagtgtttttcaacatacagttgactcttgaacaacacaggtttgaaccctgcaggtcttacttatattcaaatgttttcaatacaagtaacacccagtgtgcctacctcttctgctacctttccttctcctctgcctgacctgcctcaaccacctttgagatagcaagaccagctctccccttcctcctcctcctcctcagcctactcaacgtgaagatgacaaggataaagacctttatgatgatccacttctagttagacaatagtaaatatagtttctcttctttaagcttttttaaataacatttttttcctctagcttgcctcattgtaagcatacagcatgtaatgcatataacatacaaaagaggtgtcaactgactgtttacattattggcaaggcctccagtcaacagtagaatattagtaggtaagcttttggggagttgaaagttatacacagatttttgactgtgtacagtgtggtgctttaagtccctgcattgttcaagggtcagctgtgtgtatagagagagcctatttgagaagttggggagaggaaagtgatgagtttgtcttagagatgtgagttgaaggagtctggaggtttctgatgctgaggccagctgtggtgctaggctcccaccagggcactgccggcctgtgctcctgcccatgctggttttccttatttattaccctcccctccactgctacctcagtttccttggtgtgcccaaatcctgagatccttcaaggaccagatcccctcccaccatggccttgggatgttgtgcaggccatgtgggccagggcaggaaagaagccccttgtgggctctctcagatggccagaggggccttctgcttccagcctcacctctgcaatggctacctacattgtataaaggaggactttcatttgtttaacatcttttttttgtgccagccgctatggtggatatgtgccaggaacttacatgagtgatctcattcaagtgtcttttccctgggatatgggcagaggctccaggagatggtgccatgcagctcggagagggaagccaggatctgacctaggactctcagatgcaaagtgccttctgctgcctttctttcaagctggccactacgttgtagcatgtgggcatggtctctgcaaagacaaaacccactaggcggagagagggcagattctctagcacatttctagtgttgatgccctaatgggagtacggaccctcattggggattccatgagtctgagaagtgaaggtgatttgttaacagttgctctccctggggttagtgaatgcagtagctttaaaatgcactctcggaacttggcaggcagggcaggtgtgtcactagcaacccacagtggggaacgtgtggatgaaggatcgctggtgcattgtggaacctgcctctggggcatttctcttgaaggaatctcaccccagtaaggtcagattgcaaacacgggatcctagaggggctaaatgaggcagtattatgaacattcttttggagatacgaaacaaaacaagatcacaaacacagaatacggtagaggcttttctcttttcatagtgtctgtttttgtgtccttttatatttgaattattttaaatttgcttacctctatcagattgatggattagcttcagttcttgtgggttgagccctgctgggagtttgctgattcttgagtgtgatgagtgcactgtggccttgtattgatcaattctttgtagttttgaatcgcaaaattaggagacctggaggacatgagaatacagcatattgctagttccagagaaaatggggaaggggaacagatactccaagagatattgcctgagaattttgtagagttgaaatgcatcaatcctcagttttagggagcacagcaagttctgaacaagataagccaaatgaatggtttttttcttactgaattcttatactgcaaattgtaatttgcaatatatactcatttctttcaaagtgtcaaaaaactccttataataaaaaaaattaaaattgtaaaaaaaaaaaagaatatggtagaggcacatattacccaggggtcagggtctgaaaggagggcactggggaaaaccatgctcacattacccctgaaaatcttttagtggagagcagcattggaaaatgacaaagtggctctctagaaatgcaccactgcattgcacagttttatttttccatacttggatgggatcagtatttgtttagatgatctcaaattgaaattcgtgcctgtgtttagagaccagctatactataaatgcatgtgtggaaaaagccaaatctccttctggatggatgctgacactgtgagggccatgtgcaaattaagcctgaattgatggaaaaagtccttgagggaccgaagtccattgttaaagtgatggatgatactatacattttatttaaatcatcctttcttcttttgtcccccgctcagcattcacattattgtcataatctctactggagggcattctctactggaaggtggctggttcacatcttgtgctgtcttcagagaatggctggaaatagtaataatgttaatgacagtggacacttggatatacatggaaaatatttagtttgtactattgaaagctgtcttaaatttgagtgggtacttaacgagaaatagctaggtatcttatggactatatattatgagatagcaaattggctatgtccaacctgatttctttaaaacaagtcataggttacctattgtaattttttaaaatgcatctaccctagaccacagtaaactctattgtgattgagattgggagcttaaatcaaacacctaacaatgctacatttgcttcatctttttttgggtgccaggcaaccttaatgattatcagcgcacagagtgttacctagcaacaaagccaatttgcacaaaagcaaccagaataagatcatgttttaggatggtagtcttcaattagagaaagggaaaactgcaaacatctgatttagatccaacatgctccctattactctcctgtatcaccgcttggtttccttaatgtgtagcttcattaaaatgtgacttcaagggaggttgcatccctgctagaatctttagagtaaacatgtgtcaagattcagatcattactgttttgcccttaatttggcctaaagaagataagcatagtcaagagaggaactttgttagacctttaagtcagtgtgatgttgttatgtagttaacgttactacttagagttctggagttcaccatgcaactcaggttggaggtacatttgtttgatagtaatgagatcattgagggcataagtgaaggaagattagaagaggggacaaagcattgatccctggacactccaacatggagtgtatggagagatggggagaaaacagccaagcaggcaagaaagagaaatcagtagcaaaggtggaagacaaggaagtgaaccaagtccactaatggtgagggtgtgatcagaccgtaaatgctgttgagggtcaagtaaaatgaagacttaaaaaatggcctttggatttagtatgtggagggctctagtgacctctggaagagcaattttagtagtgtgaagggaatgaaggtcttattagagtcagttaaagaaagagcggaagaagagaaattggcagcagcacatcttaggagttttgctgcaaaaaaagcaaagaaatatgatagtgtcaaaaaggaaaagtgaggtcaagagaaaaaatgctcctcttccattcaaataattcaaagacaggaatcacagcagcatatctgtacacagatgagaatgccccagtagagaatgaataattggattgagctacagagcaggtggcttgctgggacactattctgtatgggacaggggaagggatttagacaagagacaaggggttgtctctcctgagagcacagcaggctcacttacaatagaaggaccaagagctgagtctgtgagtacttccattagcttcattgtttttcaaggtagagtgcatgcacagaagggattataaagttaactagtcagaagaggatgcatggaattgagagcctggagaagatgtgtttgttagaaattacaaggtctaggatgtaacttggttgtgagtaaatgggattggtggagtgaagggaggatatgctacaacaaatactaataaaatctctaagaataatgataagagtagagctgaagaaagagacagtgcacaagagcagattcagggatgggtagatgacaacagcaatgacaacaacacccaacagtggatgatatgctcagatgacctgagattcaaggctgggggcttcagcagaggtggggaaggtcacagtgagacaaaaggagacacctgccccacatggagacccagtgaaggaaagaaacagcagttatagaacaggatttatgatgggtatgtgttctggctcaagcctttctctcctgtcttatctgaggtcattgtatggttttccatgtatttcaaggacagaatctctttgttccttgcatatgctattctttctcccccaggtcctggcaagtgctttcctcttttttttttttttctggaacacactgttcaagcatccccacttcacttactctcactacccatctgactgatttcatatgccactgtctctggagtcagagggaatccctatagctcctgggactttatcattaccctacttacctatactcttattataatttcttgcctgtcttttccactagaccttgaatttcttgaatcaaggataagatttgatttatttctctagccctagcaggtggcaggtgccaggcattgtaggggttcagtaaacattccttgaataaatgaatggatgattaaagagcagcatctgaaacacattctctggtgcataattgggtcataataggagaaaatatcttttcctcctttccctgctgcctagcaatgttctcaattagaggattatcctgtccttttgagaaggaatttggaaatgtaactttgaaaaaattatttgcttctttttgatatgtataagatcaataactagaaaaacactagcctctaaataactttaaaattaaaaaaaattcaacagattaaaaacttctggccagtgtttacaaattgctgtcttctttaatttttaagtccactctaagcatatgaacaatgcccagaaaccagcagagtggaaatgactgggctttgcaatggggttctcttcctgctgcaatgataggtgttcagacattgttttgctgaccctggccaatgcctcagtggcttagagtcctaggaatgtgtcattctgtacaaaataagtcaaggacttttacttccattgaccttagtggatattatattcactgattaaaatgccatgagtgctaattatcttcagcctccatgcctggttctgggaaaacagacataataagtaaaggggcttgttcttggggaagccccagtccatgtggggggtgagacacttaacaggtacatatgatacgtgtcacagggacccagtggatgccagtgtgtattctggcttcagagtgctagtggttaaatgcagttcttccacttagaaagcttttaacaatatatgctatctctctcttgggttttccaaatacaatgtggttctaataatgagaagaccctcatttggaggttatgtggattataataatttatacacacaaagcacttagactagtagtacccagtgtatgatacatgtctaataaatgttaaatatgattatctaggcttggagctaacatttaaaaaataaaataaagtgactgggatttcctctgtaggaaagcgtttatgaaatgaatgaatgatattcttcagaattatagattctacagtattgtgatgtgatagaaagttctactttaagttggacctctccaagaccaataactcaccatctcctgtgagcttcccatagcatgttgattatacttcatctgtaacatttatctcattgtgtcctaattggatatatacacatgatttatctagataactctgatttcctgcagaaggacctgtgcttcgttgctctttgatgcccctacctttatacccaatatgcaaccagcacctatgatgctatagaccatttgtgcaatcttgcaagaatttataaaatacacatgaatgaaataccctcatcctcacttcctccaccctatcattattacctactgctcttggcttcaagaattttaaaacacacacacacacacacacacacacacacactatggggagcaaaattgtccataaaatgtgtttgtatattgaaattcaaagtgcatcaggaaaacaggcctccactaaaaacagaagtaaaaatacagagtgaaccagatcggtcagtttaatgctaaccagttgcataagatataatagagagcaggccccagcttctttgcataaatttgattgtagaagcatggttggtcccttttgcttacatcttgtttgacacctgtgtagtgaaggttctgtgaaggactgcacaggtggggacaaagtgcagggggccagaagcgttcctgaagttcaatgccaggtgtatgaagaggaggtaggcttccagcttgcttagggtgcacaatgaggcagcagcgtggggccaccccagagggtaccatagacatcccaagtagtaccaatggaagaaatgaagaaggaggggtttggggttgaacacagaaaggtaaccagaacatgcacgtttgagaacatctgacatcttactgacttgttttcttgtctatttgtcttctctgctgactgatctctggttaatgtgctaagtttaatagatcgacctcctctgctagattggaatctcgcagctgggaatgtgttgggagattgcagggctaggcagttacctggtgaaatggaaacatttgtcttcctccttccaatagggtgttgtccacactgggaacacatgaaaaacaggagcataaattattactataaatttaggttgagatttaaccagcagaaaatgcactataagacttggatgaaacattaagtgcacagagtgaacactaaaccctaagaagtgggcttgaactctttctagttcaggatgggaagtatttacattaaatatttacttagtcatcaggcagaaaatgggattcacccaattctttgcttggaattctggaatgttccaggccccaactattcttgaagctcaactgtctggaacatgtcaaatcctcttctgcctgtctagccttctctctggctgcaaaatggcaccatgacttcagctgctggctatcaggaaggtagaaacatgcctgcagctccgaggagacactccactttggtttgagtggtcaagggaaggtttcaggaaggcattgtttaaactgggtttgtaacaatgagtaagatggtaaataggtgatgagggcagtaagtattcctgtagagttaacagggccacagtggtgagggaagttatttgtgagaaaagagagtggatccctggaagaggggtaaagtttcacatggggaaggctttgcactgggtatctgagatctggaactcctaagactgaaagatccctgcaacggaacaggacacttgttcttacattaatagcaaatgataatttatactttgcacgtggcatttcactggaacatctgcattaatcaggaaggtcgggtgatccagatttagtggacagtggccagggagtgaagggcttctctgctgagcagtagagctgggcctgccttgcttcttctgaccacactggtacatcagccattccaccatactccataccctgtagagggatgcagggccctccctggcagaaggtatgagtgaaatgagagacatgcttctccagagaggagacaatgcaagcatttccaagcacaattctgggcagatattgctggtctgcatcacggttggtgtcccttggcgtggttccatctgaacctgaagaaagtcaatgctgctctggtgagactcacgtgtgtgtagcatccacacctctgtgatatatttgtggtttataacgatttcagccactgttagtcattatttctggagtgaaattagaagcaaagttttaaggtgttcagggagaagagtgatgttttcttctaatttcagaactcttcaggatgtggacttaactcagcatcagcacaaacagacccgagctctgtctggaggcctgaagaggaagctctcccttggcattgctttcatgggcatgtcgaggaccgtggttctggatgagcccaccagtggggtggacccttgctcccggcatagcctgtgggacattctgctcaagtaccgagaaggtaggcactgggcctcattctgccttctcttcccacaatattgtgttgcaggaaatgcattgctactgtacagtagaatcaagttgtatcccagtgaggctacattatccttttcagaaaaatataaatttttaaaagcacttatagggatatattcgttagataacatctctatagtgcttagaattgcttactttgtgtttgaccttttaactcaataacagcaatgacatctatgtacattatacattatcatacatgatttcaaggaaaattgtcttcttctggaagcatagtttcttagaagaggcatcccagatcataggacaagcctcccttgtctcagatgaagaaatgaaggctcagagagacgggcatgtgatttacttgtagctacagagaaagtttcctgaactgagggtggatgttgaacctcttgtccatgtttctcacatctattattgtttctttccaatttaggacatttgatgggcagttactaatttccaacttctgattctttctgcaatcctgacagctaggaagcattgttctatgtattttctgtgagaatactcccttttggaaagaaacattgcaacagtaaaacacatcttggtgctggtaaataagtgtagaggcatcagtggcaggattaatacagattctcataaaatgttattttgctttttcttttgccttttgagtataaattttcttctgacttaacctaaagtctccatttccctggaggtgaactaggatttgcaaaggaagaaataaaggaaaaataacaagaaagagtccttctttttcttagcatatagagggctgaggccagaagtcttggaccatcaaattctatctttggagtagaaaaggtactccagtctgtcacttaaagcttaaccataggctggagtcagaaaggagaaaaataacaaaagggagcatagaagatcaatctgtttctttctgtcccacaattttgttggaattatggaaggagaagatagatagaagtgggaaaattgagcaagcagatgtgactttttgttccactctgggctttggcctggcctgggcaattgcactagaaaagtgcaggccacatctgcggtgctggctcctcaatcatggtgcagccacatcggagttcacgaggctcagcagaaatccaggtcccagtgaggcactgagggctggtattccctaccttttcatgcccatgaactttgacattgaaagacagggcttgctaggcatgctgccatggaagtaggggaccccttggagctagctggctggaagccagggcagagattcagccgtctgcagtcagcaggacctactgtgaggcctagacagcctgggagcactctgctctggcctgacccctttggagtccaagctacaaatgccaaggtggggaggcaggcagtgccatgtggttttggttgacacccagacaccagatgaccctgaccacattgcacccaaagattcgaacccttccccgttgccacaagatcaagaagactcctgactccatttacctaagtgtctcttggggaaagacatagaaagggcagacatgggatactgaccaccacttcaaaagattgattaaattttgagatgcaacgatttaaactggacgaaacaatttgcgcactaccctggctggggactgatgcggaagatcaatgggagatagacaaatagataacattgtctctgcacctgtgaattgtggtgcaaattaaataccacaagcccactactcttgtttagtttaaaaattagagctggagtctcaaaggtttagctgacagaacatttttgtaatgagcacaaaggttattttagacagaaaaatagatacaatgaaagtctcagaaacagacagttttcttcagtttctgttgttacaaaccaaatattttctcactgtccttcgttgtttagcaattttttttgtctttggaggacttttttgaaatcatccctgcactgactgaagtgcaaaatcaatagtatgtaagcgattagataggcggtattggaagaaaaatgtgttttcaagaatcaaaatgtatagccatttctgaagcagcccaaacctctaggtaatcatagagctctgtgagacagatctaaggactgtgcagaaacaaacacttccttctgagaagaaagagctcttctgtcggaataccagtgcagtgggggctcagtctacctggaattttgtgtgtgtttcttgcttagttatgtacagtgagggctcttgatcagccctggtaccagtatttctgtgtctcccatggaaaaataaataaggaagcaaaaaataccggtgaaaactggcacatctcaactaaatttctgttctggggtatgcacttgctctacaaatcccatgtgaccctgcagaaatgatcaaatgcttctgagcttcagtgttctcatttgcaaatagagacaattgtaccatctcataggatgtgagagggcacagttgtatgtgaaagtgcacagttctgtatataccatgtgtgcgctcaatcaatgacaggttatcattattattattaaaatagacaaggggcgaatgtgggaagcgcagcttttggaggaacatatcatctgaatcagagagagaaacagtcaaacagtgtcttggggaaaacagtagcattgctctttgaggccgggcatggtggctcatgcctataattccagcactttgggaggccaagatgggtggatcacttgaactcaggagttcgagaccatcctggccaatatgatgaaaccctgtctctactaaaaatacaaaaattagctgggcatggtggcgcatgcctgtagtcctagctacttgggaggctgaggcaggagaatcacttgaacccgggaggcagaggttgcagtgagttgagatcgtgccactgcactccagcctgggtgacagagcaaggctccatctcaaaaaataaataaataaataaataaaaataaaatatatgtatatatatatattgctctctgaggctttggatgtgtcttgaatttccttaacagccactaaaaagtcatcaagggtcaaatgcctgcaaacttaattgaaattctttggaagtttattcatttatttattttcccagcttcattaaagtataattgacaaatgaaaattgtgtatttgtggtgtatagagtgatgttttgatacactgttgactccttatatccatgggttctgcatctatgggttcaaacaacctcggatcaaaaatattcagggaaaggcctggcacagtggcttatgcctgtaataccagcactttgggcggccgagagaagtggatcacctgaggtcaggagttcgagaccagcctgaccaacatggcaaaaccctgtctctactaaaaatacaaaaaaattaaccaggtgtggtggtgcatgcctgtagtcccagctgcttgggaggctgagacatgagaatcacttgaacccaggaggtggaggttgcagtgagctgagactgtgccactgcactccagcctgggtgacaaagtgagactgtgtcaaaaaaaaaaaattttcagggaaagaaagccaataagaaataataatacagcaataaaaataatacaaataaaaataatagagtataacaactttttttttgagatggagtcttgctctgtctcttaggctggagcccaatggtgcaatctcagctcactgcaacctctgcctcctgggctcaagcaattctcctgcctcagcctcccaagtagctgggattacaggtgtgcaccaccaagcccagctaatttttatattttttagtagagatggggtttctgcatgttggccaggctactctctaactcttgacctcgggtgatccaccacctcggcctcccaatataacaactatttaaatggtatgtacattatattattaataggtattatatgtaatccagagatgatttaaagtatatgggaggatgtacttaggttatgtgcaaatactaccccattttacatagggattttggtatcttcaggggtcttagaaccaatgctccacagataccaagggacaaatgtatgtatacattgtggaatgattaaatcaagctaatttacatgtgcatcacctcacatatttacccttttgttgttgagggcacttaagatctaatctcagcaattttctggtatataatgcattattactaactgtagtcaccatgctgtacaatagatctctagaatttgttcatcttgtgtcactgaaactttgtatcccttaactaacatctccctccttctcctccctccctgctccctgccccgccagctcctggcaacaaccattctactctttgcttctcttttgggaatttagattctagttgacttttatttttagacttcattgtatgggaatgtatcatctgaactacatgatagctctagtcagatgatctaaactgcctttaatcctagatcagggattaagcaaattttcttagcctcaaaggtctaacatgcaaggagcttggccttgggtgtggggacagggacatacatgtgcaagaactggtcattgtggaccttcaagctctattgcttttgtgtctacgttccatagtttatttgtaaatgcatcttttttttaatgtattgaaagtcttagtcttttaaggtgtctcctctattattgttattttttctacttgcattttgtttttaattgacacatgataattgcatatgtttattgttttgatttttttacttacattttaaattcaggggtacatgtgcaggtttgttatgtaggtaaacttgtttcttaggggtttgttgtacagattattgcattgctccggtattaagcctagtacccattcattatttttcctgatcctctccctcccggctccctccaccatctggtagacctcagtgtgtgttgttccctctatgtctccatgtgttctcatcacttaactcccacttgtaagtgagaacatgcggtgtttggttttctgttcctgcattagtttgctaagcatgatggccttgagctccatctacattccaattatgggttacagtgtgatgttttgacacatgaacacgttgtgtaatgatcaaatcagggtaattagcatattcacaacctcaaacatttacttgagtagagttaaagacatgtttagccttctctctttgaaaatttacctttggaacaagaatcagtcaatgagtttctttctatttaataaaacggaacaggttgaatggggctcagtgaaagccaatagggagtgtcgaagctaaaagcagcaacatctttttacataactgaatcaacttcaccaaaatatcttctagtttctttggcctctgctctgctaaagctaaatctgaggcttcttctttacaagcaaaagtcgtaaaacttgacaagatgctagaatgcttagagaaaacatttgaatttaatattggtttctgccaaaggaagccatgcccactgggctcactgatgactttcctgccaggaacacccaagtccccctccaccctggctccctgtgtccatcacccacaacatactctcctctctgtggttcatggctactgtgagcttttccaggaaggcattgcatgttctgatgctgctacttggaataatgaatacatgtggttacatcatccctgattccaaagggtatcaatgtataccatggccatttcagacctcttttttatcactgatttctgccttaactcagtgctatgattttcttattcaattgcgcttccataaaatatagccttctccctacatacatctcccttgtcatccaaagaagaatgaggagggccaggcatggagggttcacacttgtaatgccaacactttgggtggccgaggtgggtggaccatcggaggtcagaagttcaagaccagcctggccaacatgatgaaatcccatgtctactaaaaataccaaaaaaaaaaaaaaaaaattagccagacatggtggcatgcgcctgtagtcctagctactctggaggctgaggtgggagaatcgcttgaacccgggaggtggagtttgcagtgagccaagttggtgccactgcactccagcctgggagacagagcaagactccatctcaaaaaaaaaaaaaaaaaaggatgaggaagaggactttagtatctgaggagagagataaccacccagcttttttttttttaatttattctctccgttcattcagtgatctgcttcaaagacagagagaacagggggctgtgcacaagcactctgttttgccccccagtttcactctccgtgcctggcagagcacccacttttgttcatgggggtggggatgggagatccgtggaaactactgtagaggaaagagtttcagggcctcgaattggcaaagtggccaggacgcatttcaatttttttcagtttgaaaattggtgaggatctttaaattgtgccctggatctaccatcctgaggaaaggagggaaggtcctcctggggcctttgtcctcctggtgctgatgcaccctgtgcttggacccaggtcgtacgatcatcttcacaacccaccacctggatgaagctgaagcgctgagtgaccgcgtggccgtcctccagcatgggaggctcaggtgctgcggtcctcccttctgcctgaaggaggcatatggccaggggctccgcctgacactcacgaggcaggtaaggagtgcaaccattctatctcactgaagtcccatttctgtctgtggcataagaaacaagtggtgacagttacatagtaataacgtctcagtggaggccttctgtgcacaatggcccacatgccaaaataagtggccccaggcctgtgcagggagcaagcctctgggaacccaagcatgcattttgaccgccaggagaaaatacatgaggagtcagaattacctgatagataacaggagctgctgtgagtgtcagggccaggaagtatatgacctatgtattctagaaattcttttctctttctttctttctttctttctttctttctttctttctttctttctttctttctttctttctttctttctttttctttctttctttctttctttttctttctttctctcctttcctttcctttccttttctttttctttctctcctttcctttcctttcctttccttttctttctccccttcccttctctttctttctttctttctctttctttccttttcttttctttctccccttcccttctctttctctttctttctttctctttctgtttctctttccttcctttcctccctccctcctccttccttccttcttttcttttcttttcttttcttttcttttctttcaatggagtcttgctctgttgcccaggctggagtgcagtggtacaacctctgttcactgcaacctcccgttccaggttcaagcaattctcctgcctcagcctcccgagtagctgggactacagacacatgccaccaggcccagctaatttttgtgtttttagtaaagatggggttttaccatgttggccaggctggtcttgaactcctgacctcaggtgatccaccaacctcggcctcccaaagtgttgggattacaggcgtaagccaccatgcccagcctagaaatatttttttgacaacgatattaccctcctagaggctaaaactttgccagaatacaagagagtagtgagggtatagagcaagtggagtctggcccgagaggctgaacttgggtcacatctgtagtcatcattgcctgtgtcaaccgggggcaggaagtggtgactctggggctgggattcagggtgtgtgggaaatcacctctccactcttgatgactgtatttgacccttggtggcccacgaaaagtcttccctcacctctgagccaaggttcctgtttgcttcctctctcattcagcgtgaatgtcattatccccaggtggctcctttcttctttggctgagaattcttgtctcccttttaagactccttcaacccagttttctgctgttcaatgctaggcccaggatctctctgtgactctcccagtggacggggggcacttcatgaatacaaacctctggaggctggccatggcaggcccagtagctaagacgggcatgttggggggcatgtgggtgtggcctcacaaggtttatcactgcagatttatattttttaaaaagaaagaaaaaaatacgagatgtcattgagatgcctattgcttaagtgtgatatttcatttaagctttgaaatggagttttgaaataatttgcttatggatatacatgaaatcaattgatgtatatatggattaacattccttactggcttcttttttccttttttttatggatagccttctgttctggaggcccatgatctgaaagacatggcttgtgttacatccctgataaagatctatattccacaagcatttctcaaagacagcagtggaagtgagctgacctacaccattccaaaggacacagacaaggcctgcttgaaagggctcttccaggccctggatgagaacctgcatcagctgcacctgacgggctatgggatctcagacaccaccttagaagaggtactgagaaaactgaagcgtgctttaattatttatgcctttttgaccagtccacattaaatgaagagatgtgggtaaagggggggagatgtgggtaagggggaggagtgtgcacttttatttacatttgatttctgattggtagcatactagatgccaataactgaacttaacaggcctgacaggtggcaattgccctttaagtgaaatggcattcttttagcattctttttttttgttttgttttgtttttgtttttgagacgtagtgcaggctggagtgcagtggcgctatctcggctcactgcaagctctgcctcccgggttcacgccagtctcctgcctcagcctcctgagtagctgggaatacaggcgcccgccaccacgcctggctaattttttgtatttttagtagagatggggtttcaccatgttagccaggatggtctcgatcccctgacctcatgatccgcccgcctcagcctcccaaagtgctgggattacaggtgtgagcccatgcacccggcctcttttagcattcttgtatttgagaagcttggtgtctttaattcagaatcatgaggtgtttaaacagttgtcagtagtggttgattgctggttgtaattcttcatgtagagatgccctcctctttctgcttctgtctgggagtctctggccccatgctgggtatccgtgatgtgagagggtttagcacgggaacactgcagacgcctggtgagctcccatcccccaggtcccacttttctctacctggatctgaggtggatgagaccactccatgtgggttcttcatagagtacacttaacaacaggcagaaataggcgtttcctccaggaggacattgctacgttgtgtgacccaacctgaggcatgccttgtttggggttcttgaggttggctctctgtgtgggcagtatttgagccctaattttacattgctattatttatataaaatgtcacgggttttcaaaaaatcaagtgctgcaagttaaaatttttaaaaatctgcaaaagtcaaagtctgaacattcagttgtgttttggaattgattccttgggttagtgatgcaggaggaaaggcaatcttttgtgtgataaatcagtgtggtcccaagtagatagcctccatcacaagttttgtctggaataaatagtcataaaagattgtgaaacataaaaaatattacaaaatgcttttatacatagaatgtatttggttcccctgaaactccgtaacttattattcctattttaaggttgagtaagctgaggctcacataggccaatttctttaccccaaatcacgaaggtcgtaaatggtgagctctacttagacctagggtttctgatagttagtcaagttctctaaattagcccatacctttgtggttgatgctctgtattccatgcatcatcaggactggagtccatccattcccactgcgttttaatagagcaagttacagtgcaagagacaaacaaaaagcagcctaataaacacacatgatgaataggagctgttttctaaagccaaaggatgcggtcactacatcttttcttgtctggctgtctcctattttcattcttcaagtcttgacatgaacggcgcctctgcagcggattcccagattcctcagcatcaattctgttccgtgttctccccacccgccctcactgcactctgaagcttttcttcgtgacacttctcccaacttgttatgcatgcttctctgtctctcccatggacgctgagatctgtgagtgcttgtatcttttctgcccacctctatagcagcagtgcccaggacagttactggcactcatggttgcttaataaatattttctaagtgaacaatgtgctgaacctttccaaagattcatccagctatatttttaatataaaatgaatattttattatttaataaaataatacatatatattacacataatatacatatgtatacatatgtaacatataatatacatacatatacatatattacatgtaataatacatagatatttaataaaacatatatatatgttcagggtttcgttgtgttgctcaggctggtctggaactcctgggctcaagtgatcctcccaccttagcctcccaagtagctgagactataggtgtgtgccactgcatctggcaccaagattttgatctttaaaatggaaaaatcagaacagtttgcctggtttcccaaggagtaacaatcatgattaaatgcctggaacaagtctgtcaaaaatggtaatggcttttctcacttacagtgggattgcatgagacgttgctgccgtagctttggagtgaccacggagctaaataacatctatacccccaaaagtcacctttcctccaggaatttttgggagacagcagtcttccctgggccaatgtagaacaagaaggaatttcctaagccccttttccccagattgcatgagtcagaatgcaggtttacagacgtgctgctaactaaagcaccatacttgaatgcagctatgtcagacaccacagttgtcactatcttcttaaatgtgaataacaagtccaaatattatattggaagctaatcatttggacagttgagagctgtcagctggcatgagtcagtttccctacagacagaaggaggcgctgcttccaggggtagttttgccatcctgggtcacttggaaaagaaaaataaaataatttttttggggggttatcgagagaaattgtcaaaaaagcccagacttcttatgttcatgtctgtctctctaatcattcaccgggttaatccggttgtttactagttgtatggtgtcttgtacagataaattgaacatattcataagctcactggactctcagggcagggaggaagatgctgtaggaatatggaccaagcacacttatcagtgaaataatgagtgttcacccccaatgtatttactgatttgcaattaaacacatgcgacaggaagagtgggtgttccctttacgtaagtggcattttgcttgttgttaacaaaagagaaatccttggtaatacttttaatttttattattaagaagagtgaaattttgtggaacattttgcttcaatattttatgaatttaaatatcacagaaaaaaaaactggtgaggaaagcctttatatcacgggtggatgcttagctcttaattgttttgttaattattgtggcatatatgaccaatcaataatatctccaggtaaaacatacatttagggagaggcttattcataaccatagcacatgtgaataagatacttcagtattctttttagtaattcccttccttcctgccttccttccctacctctctctttttgcctcccttcctccttcctgcctacatccttctttcctccctaattttcaggtctgtctgaatttttagtcacatctgagactaaaatgaagatcccacaggagtaagaaagtgtcagctgtgctgtttcatgtttgctgtgcttgtgttgctcgtattatcttcagaatcttttaaagccactatctcctttataagtgttattttagtaaaaactagataaatcaatgtaaaaatctacttagacaggcctctacaaagctgcaacctgttgaaacttgaagaactgtcactgtggccacagaggccaccagtgctcctatcagtcttaaataggaggaattctttatgtctgataggttccgcctaggaatagaaactgagatttccatgtttccttctgcaccccctggggtgctgagagagctgggcctcgacagagcctgcagggccacggggagtggtttgcattcttgaccatgcatggtgctccctcactgcactcactgcagaatgactcccctaccttggcacccttacctgtaggttgggaatcatggaaggaaccacaacatagggttgaagggaagaaacttctagtgcagcgcgtgacacacagacagacgacatttgttctgcttgatagggacttgcatgagatgccctgggaggatccccagtcggagagtgccccgggaccaagggaagcctcctgcaggcgctcccagaggacaaggctggagctgcaacctgggtgtgtcttggggtttagaggctgcaccttttgcttcctcaccctccaggtccagcctcccacctgccccagacccatgtccatgcttctccttctgatgtctgccccttccccactctcttccctacagagctcgggcctgttaagagcttgctgtacttcagtccttccatgctcagaattctaaaccagtcttggaatctcactgcatcactgcatatacctttttttttttttaaacaggagttacccatttcacaatatttatcttgaacagtttttatttttcccatagtcatgatgttcatggtgacataatttcttttacaaaaatgtgtccttatgtagttcctcccctccctgctttaaggcactttggttgtttctaaagttttgattttaccattgagactgtacaagtccgaagaacaggatcccccagcttttccatagactgattcctagaaatgcaattactgggtccaggggataaccctcaagatctgtgacggggtcaaatgacagaatccccaaatgatgacatgcatttgtgtcctagatgcttttttttcatatgcctcaatcttttcaacatttcaaaagaaacccagtgccttctagtcacatttaggatttcctaactggcctgctgccccatatcttcttcaacccatggttgccatgggaagggcctgggaatcaggacaagaacattgacacttgcatttatgtttcatcacttcctgtcggggacaatctggacaaatcacttagactggaaccacatttattcatttattttaattttaaaaaccttttaaagagcagttttagattctcagcaaaattgagcagaatgcacaaattgtgcattctgtgtccctctgcctcccttgcccccagcctcctccactatcaacatccctgcagaatggctcatttgttacaattgatgaaccgacatggacacatcaccatccagcccattaggcttcactcttgctgttgtacattccatgggtttggatgagtatataattccatgtatctgccattatagtatgatatggaacagtttcactgccctgaaaatctcttgtgctctgcctagccattcctccctgcccgaagccccagccctcagcaaccactgatctttttactgtcatcgtagttttaccttttcctgaatgttgcagagttgggaatcatacaacccttgtagcctttccattttggcttctttatcttagtaacatggatttaaattttctctgtgtcttttcatggcttgatagcttatttcattgtaccgctgaataatatttcagtggctgaatgtaccatagtctatttatctattcatctactgaaagacatcttggttgcttccaagttttagcaattatgaacaaagctgctataaatatctgtgtgcagatttttgtgtggacataagttttcaacttacttgggtaaatacctaagactgcaactgctgtatcttacagtaagagtgtctttagttttgtaagaaactgccaaactgtcatccaaagtacctgcaccattttgtgtttccaccagcaatgaatgggagtttctgttgttccatattcttgccaacatttggtgctgttagagctctggattttagccattctaataggtgtgtagaggtatctcactgctgccttaatttgcattttcctgatgacatatgatgtggagcaacttttcatattcttatttgccatttgaatatattctttaatgaggtgtctgtttaggtctctggcccactttttaaaaattgggctgtttgctttcttattgttgagttttaagagctctttgttaacttcatttttctcatccctacggtaggtttatcttccctatcttccacacacagtttttgtttaggtcaaatcatataattaaactgagtgcaggttacatattgctggattgtggcataaatatgaggaattatcaatattttttctactatttatatccaaaacacatatgcagtggtgtattttcagattagacactgttatattttaatctgtctatattttaatgttacagaataccttgcattatagaataacttctaaaaattctttttatgttatgtattagtccattctcacattgctgtaaagaaatacctgagactgggtaatttataaagaaaagaggtttaattggctcaaggttctgcaggctgtacaggaaacatagcagcatctgcttctggggatggaaggtggaaggcaaagagggagcaggcatcttatgtggcaggagcaggaccaagagagagtggggaggtgtcacacacttttaaacaaccagatctcacaagaactcactcactcgctatacactaccaaagggggatggggctaaaccattcatgaaaactccacccccatgatccagtcacctcccaccaggccctaccttggacattagggattgcaatttgacatgagatttgggtgacgacacagatccaaaccatattatgctatattccttaaatatctctgtttctgtttagtagtcacctttcttttacaaaatatttgtatttgtactttacccattcatattccttttggaaatttctcagtcttcctcctctttgccctcttttcttaaaaaatttatatttatgtacttcatatgtaaaattcctacagtaaaattcactatgagtttgacaaatgtatagagttgtagaaccaccactccaatcaaagtacagaggagtttcatccccaccaccttctgaaaagagtaattcttccacgtaacatgcctctgcaattttttaaatccaggattcatgttcttgctgttagtcaccccagaacagcaagaactcctcattagtcagtgaggagcaacagaacaagttgttcaattactttggagatgtagtacatgtttcttcaatttcttacagtaatttctactttctacatttagtatgtgctttgcacataataggtcttaaataaatattgatttactagattttacgtatctctctttttccacatctctcacacacacggacgctaagaaagaaattatctctctaagggcaaccatgggcaaagaatctggaatatatatacaatgtatatgagatctaacaaaatataaatggtatatttagagccgtttgagaaaggtatcttaaattggaaaaagattggggcttttggagaaccttcttttgtttggtagaggctataaaatgtctgtctcaaccaattttgtctcttgacacttggcgagcattgactttcctttcttatgtctgatacacagttagcatggctgttgtagcgctgagggtgcttttctcttccttcatctgcattttgcctgatgactttacaggagtgaggaggacctgccaattaactctccagttgagctcttcagctaaaaagcatattttatttctaaactggaatacacttactataaattatgatctccaactttacctacaagctagtgaaattaagatttaaaatgaaatcatgatagtcaccagtttcattaaggcatctgtactttctactccaatgcttggacctaaggacaatcctggcaagttacaatgtttactttgtgtgggatgggaccatagagagttagaagacttggctttgcatatggaatatattttcggcaatctctgaagccaagacaaaactttctggcataatgcaaacagagtaaatttttgcagtgtattttttaatagttttgaagtttttagtaatgttttagaaatgctggtgagcctgcctgagatgtgaagtttctttccttccagcttgctaaatactgattagtgggttccctttgtacctttgccaaggaggttctggatgctagttccttgggtgcatgaactcagctgccccatcctacacagcattaagaggtaaagcctgggcctcagatgtagggcttgatctttttttttttttttgacttttttttagaacaatttttaagaaaaaagaattgctgtaaaatctttgcccatttaagtttcaattgtgcccctcatgtccctaagagcaaaaggatccagtccaggatcacgagctgcactcagttgcaggcctctttagtcactgtcaatctgcaagaattcctcagtttccttgactttcatgacctcaatatttttgaagagtccagaccacgtattttgcacaatgagcctcaatatgggtttgccctattttgctgtgattggtcaggttatgcatttttagttggcatattccaggggtgatgctgtgtcccactgctcctggctgcctgctacacaaggctgatctgtcccatggctagtgaggtgatcttttttcccaggtaaagtggaaagtggtgtctgccaggctttcccactcttaagttaatttccttttctctctctttttttttttgaggatatattttgagaatctgtaaattccacttttcttacccacctgtttttgcatcttctgatgttccttgccagaattaaaaattattactatggcacttgccaagtggcgatttttctaattccatcattccttccatgtgttttagttggcattgtccagtaagaaagaactctctctttaccccattgacctatttatataaggaaccactcatagcattctattctactcaatgagttacaattcagtagggtcattatttactttgaggctcatgtcataccaagttgagccagtgggaggtccttcaagctggtttttgtgccttttaactcatgcctcccattctttgagcattttcctgcttcctgacaaaacaagatgttctaggattgccattctttcccagccctggctctagaatcagccatttctccaagaaatcctggctgctcaatacgctcatggtgattggggtgttgctgctctgaggttccctcatggataaagtaaaagatccacctctatttttgcttctctttctgcctataaatacaaaactaggagttcaactccacatctctaattccaatccaattacacagcattcatttagtgtttcctcttgccttatttgtaccgcccttcactgataatgagaaactcgacttactcattcttatgctaccttttcccttagtcctcctgtgtgcagctcatcttccaaggcctccacactgctttgctgctctgctcacatgctgtcttgtgtgaacctgccccacttcagctgccactttctgttggccccaaaccctaatctggtgtctttcttacaaaaaaaaaaaaaaaaaaaaaaaaaaaaagaaaaaaggaaagaaggaagaaagagggaggaaggaagagaaggaagcaggtacttttttgagagaccctgttccctttttctttcatgtgacatcctgtttgttgttgtttttttcttttttttcttttttcctaaagaacaatacattcagtattttgaggattcttcatttgggggctaaggtcttcttaacttagaacagtctcatggtctaagcatttatgcagacagcctgctgtcttgttaacactgactgtgctatcagccctttgactggagtgctgtgacccattctttgcattctgtttataacaaggtgttataggatgtcacagagcctgagtgtgaactagaattgactttttataacttatgtcttttaatcttccccttgtacgaataagcaaactgagagaccaagagaccaaaaaggtaatgagctgaccaaaatcagacattgaattttttttcattttgtgttggactccaaaattttctactctacttaccaacgtctcctgttctgtagtctccagggacacctcaaatcaacagcccttgtttcaaaggtgtgttgatggtgtgatagttctaggacaggctggataatggtcccccagcgacgtccacgtccttatcactgaagcctgtaagtgttacccatatgggactgtggcaggagatatcccaaattatctgggtggacttgatgtaatcaaaaggatacatcaaagggggatcgaggaaggtcagagaggaagaaggtgatgttatgatgaggcagcagttggagagatgagctttaaagatggaggctggggccattggccaaacaatattggcagccactagaagttgggaaagtccagggagtatattatcccttgattttagcccaggaaggcccatattaggcttctgacccccagaactgtaagatactaaatacattgtcttaagccaccacatttgtggtaatttgttacagcagtgataggaaattcatacaagctcctgtaaaataacaaatcttgctgcatgcattgtgttagcatgtcaggggacagccctgcccaagatcccatatttagagagcagttgctagtacctctagtgtttcgtatcatctaagttgtccatgtgttttcatcttctgcttccttaaaaaacaatcactttggggaaacagaaagagtacatcttatgtgacatgtaggtcaagtttggaaattcttcctctgctcaagtcatcactcagctgggttccattgtccttgtcttacaaaaatttggtcagcttcaaaaatttctctagcatctaagcaaaaaagtaccttgcactgaccatctccaggacacaatccatcaaactgacactttaagtgtagatcatatctggggtctcatgctgcttgacaacaccctttaaacagagaacccaaaaggatggggcataggactcatggctgagggactgatagcacaatcagtgtagagatgacactgggctgtcataaatgcctagacctcaaagctcttttaaattaaggagatgtagatccccaaatgaagaatcccaaaacttttgaatttactgtcccttgaaaagaaagagtggatacaccataggcattgcttttaaagcatatttttgttacattttaaattactttcatgctagttagtgtcctttagacataatttcatcatgtcttattttattcttatttactttgtgtgatgaatttacctaaaaattaatgactagtttgaccaacttgattgtcctttgacttgagaagcttgtaatttcagtgaaattcaaaacattagataagattgaaaagaatattctacttcttttgtatgaaagtgggaaggtgtaggtcttatttggtccatttgaattggcttatggcctatattcagttacaatgatagaaaataccaccaaaagaggaggaagacatatgtataaataatgtcattccatactaaatgcacaaacgcagcattcttcttaaattggaaagtgtagccaggacattagatgtttagcctgcattcacttcctgtgcagttgcctaacctttatttctatctcttttggaagattgtttatatgttttgatcaggacttttatactcttaataagaatatttttgcagtattttgcatctcctcataattgttgaaatgaaagagagtttacgtttctttatttgaattactttaaaaaacttgaagaacacctttcggtataaatagtgatttaaatattgctggaaagtatgtatcagataagaaggaatacagtgagaactcagttaacattgttgatgggttcttggaaactaagactttaagcaaaacaactttttttccctcatcaacattataacaaaatggcgttgaatgagatgacattatttgaggacctgctgtatgtccttttgctgaaagttgcagttgtgaacaacaacttactgatgacgctaagtgaggacttactgtaaaatgatgtaatgtggaaattctatgtccagaattcagtgaaatgttaggagccttcttgtaagttttctttcattaaatccctgggtaatgttctattctggatgttagggttacctgaaatacttgccaaggggagttttacagttgctgtctgtgtgattcagtgtgagaattataatgcaaaataacaaaggcaaagtctgccatcaagactccaaatctttgattacagtgatcagtgtcatattgcttttgaaaagagtaacctttatttgccctctctgttaattgggctactttgacattttgtcaaaatctcagagcctcccggacagcctgcctgcagttaaggtgagttgccacttgatggcacgcataacattctgatggtcttaggcttgcctttcactgttcataggcaaagttccagaattttcagacacattgtacccagatacttagtgccgtaccataattgattgtatctcctgctgatctgtgagattattgagggcaaaaactctgtccttattctgtttcctcctctaacacacacatgcccacaaatgtgtgcattcaaacatgtgcatatacattcacacatgttcatacacactcacacacacacaccctcctccccgccacatacaactatggccttttatgagaggggctagaaaaggaaaatttaaaaaggacagatgaatattgttatcaataatgccttagttatcaaggtatgcttcatataatcatagttaaatatgaccattaaatgaaaattccatttagaataagatataaaggaaaatctttagtcaatgaataattcttgattttcactatttctattgtttcctatttaattccctataaatgcactaggtgaagacttactgcactaagcctcagtgccctcatcttaagcaaggataatagtactcatctcatcagattgatctgagaattacatgatgaaacatagcacatacaccctactacacttactcatccttatctagctactgttgagaccagacattgccagcatgctacatgccaggcatcgtttttataactttatatataaatgcatttattgcttgcaacaatcctataatatgtcttatttatttatttatttatttattttttcgagatggagtctcgctgtcgcccaggttggagtgcagtggcgcaatctcggctcactgcaggctccgccccctggggttcacgccattctcctgcctcagcctccggagtagctgggactacaggcgcccgccacctcgcccggctaattttttgtatttttagtagagacgaggtttcactgtgttagccaggatggtctcgatctcctgacctcgtgatccgcccgcctcggcctcccaaagtgctgggattacaggcgtgagccaccgcgcccggcctcttatttattaccatttatcatgtgaggaaactaagttaaagagtggtaaaataatgtgttcaaggtcacatggctggcgcacactcagaaatgttattaatcattcttcttcttattattatttgcaatagtagtgaggtttacagcttttccttggagtcttactgagaatcagcaaagtgttatctttcacatgaaggtagctgcatctgacctttcactagtgctactcatgcagattttgctcagtaggattccatgcaaactaattaaccacgtgcggagatattgcatgcctctcctgaaggcttgcttgctcatggcttcttctttctggtgccttcccccatctttccctgtggttaggggctcctcaggaacatctagagacagtcaatccctttttgcttgtttagaggaatcagaatggtgaggttgtgtagagaaatcagaagtgaggcagggtgctcagtgtgggctgagatctgtatatgcaggtataggacttcactacccagggcattgggtgggaggtaccagctggatggacagtgacgctggcccagcaggagtcacttggagaggggccagggccagggaccaatatctctatggatacgtgcagaggaaggggtgatggaagcacctgcacagatgatgctaagggagagagtggcaatgcacagtgcctagctttgtgcatggcccacagagaacgttcaggaaaccttggctaaccacatgaataatagaagacttactgcatgcttccagagtctgtgcctggcactttacagccatcatctactgaactttaaatactgtgatcatcatctctgttttattaatacaacgaggcagccaacactctgcgtggtgcagtcctatgcctgcagacagagccggcccacatcttgccaagagtggaactccagcagttaggactgtgctgctgcagggcgatgtctccttgacttgtatgcttctcgtgaattgcccaatgtttattttagagattctctttccatcactccataaatccctgccagcgatccaggtgcagctcaaggccctcgatgtctccaccccacctcatttccctttgtgtctgcttgcacttctgctttctcaccttatttttgctactttagtcatagtatttggctttgaataaactgaggttggacttctgcctccactactaaccaagaaatgacttcaagcaagttatttgattaactaccttagtgacatcatatatcatagcccatggaaagcatacatttaatggggatttttatgtatgagatcccatctactgtaagtaaactgagcattgcaattttattgtctgattcacctctgaattcctaagatgctggtacagtgagtcacaaacttaagttgaattggatacactgtgttgctatctgtcccctccctgcctaccactgcctatgcatttgaccagcctccactagcccgtgagggtctgggagttcacagtcaagtttcattcatctttgcatcctatgggtagcctgttttgctgagacctaggtagtcttagagttatgccaattaaatggatggctaaatgaaatatatggggtgtgtttggcatatgttgtcacaaccggattaggcaattgaggcagaagaaaagaaatgcgatgtgtatagaaacataaaataatacatggcgtttttttttctccgaaaggtgtttttgatgcttttgcaagattccaacaagaaatctcacattgccctggggactgagtcagagctgcagaaccacaggcctacaggacatctgtctggctactgtaagtacagaatggcttcctgcatttctgctggaggaacaatgacaccagccttattcaacatcccttgttttaaaagttgtatagcaaggttctgaagttagtgaggagatgtgagtgtatagtgagggggcaagtaaatacaggtcagaggcaaaaaaaacgttgagttttatcctggcttgaaaaaaaaaaactgtgtgtttatgggacacatttatcttttcttcaggacttgacttagtatataaaaaatttctcaatgtatacagttagaataatgaccatcattcatcttattttaccttcatcacaaacaaactgatctggcctacctgcgtggtgtgcctcttatgtgcaggcaccctcctggtaatggatttgcatggtttaacaaagccccggatgtgggctttgccttcatgcgacctctgtccctttgggaccaaatcatggcttcagcttttgtatgcagcctcctttataggctttaatgattgaacagaatccagatttggtatctaggtgtgtgactgaagctccagttcagtccaattcctggcatatttattagcagcaactcagcaaggatccctgagctgagctctagggatgtggagggtaataaatctaagagctttccttcagagatttcagtctactaggcacatgaacccatgaataagtaactagaattaaatatgttataaccttttatgatgtttcccaaattgcatccttaccagcaactgtaggaattgctattgctgtacttcctcttcagctcttagtagtatcagatttgaaaaacatataatttagctattaaaatagatgtgtagtagtttctcattgtggttttaatttgcattctcctaatgattatgttaggcatatatttttatttcccacagctttattgagatataattcacataacacacaattcactcatataaatgggaccattcagtggcttttagcttcttcagagttctgcattcatcaccacaatcaaccttataccattttcattactctgaaaactggtgtcacttagcaatcactcctcaaaatccccatctcttcagccataggcaacccctaatgtactttcaatctctaatagatgtgcctattttggacattttatatacatggaatcatagtatgtgtggccctctgtgactagcttctttcactcagcacaatgtttttgaggttcatccatgttacagcgtgccagtactcaacttattttgattaccaaatatttcattgtataaatataccacatttttgtttgtccattcaccagttgatgggcatttggggttgtttccagttttttactattgcaaatatactattatgaacatttatatacacaatttttgtggatatgttttctcttacatgtatacctaggagtgaaattgctgaatcatatgtttcaatcatttgagaaactgctagactgtcatctaaagtgatcacaccttacattcccaccagtagtatatgaagtttctaatttctccacattctcccaacccttgttattatctgctgttttgattacagacactttagtggatgtgacacacaccttagtgtgtatctcattgtgggttttatttacatttcactggtggctaatgatgttgaatatcttttcataggcttcatggccacttgtatattttctttggagaagtcatattcagattttttgtccattattaaaattgggcagattttatttctagagctggaagaatttctaattatggaattgtgtgagttaagtggaatggtaactaggttttcataaatgccgtttatgaagttgaagaagtttctatctgttcttaattgtggagtgtttttaatcatgaaaggtgttggatgttgccaaatgctttctctgcatctattgagatgatcatttgttttttgtttatttatttatttatatggtatatttttggtttttggtagttaaaacaacattgcattcctgggacaaattctacccggtcatgtcatatattgctggattttattgtgctagtattttgtggagcatttttgtatctttatagcaggtattggtctgcaattttcttttcttgcagtgtctttggcgctgttatcatggttatcttcacctcatagaatgagttgagaggtgatcccttctcttctattttgtggacatgtttgtgaataattggtattagctcttctttcaatgttttgtggaattcaccagtgaaggcttctgggtctgggcttttctttgtgggtaggttttttaattatgattaattcaaatatttaattgatgtagggctattagattatctatatttttctcaaatcagtttcagtgttttatgtctttctaggaatctgtccatttcatttcagtcgttatgctattttatgttattggcatacaattgttcatagtaatcagttataattccttttgttttttaaaagtctgtagtgatgtttgtcaggcgtggtggctcacgcctgtaatcccagcactttgggaagctgagctgggtggatcatgaggtcaggagatcaagaccagcctggccaacatggtgaaaccccgtctccactaaaaatacaaaaaattagctgagcatggtggcaggtgcctgtaatcccaattacttgggaggcggaggcagagaattgcttggacccgggaggcggaggttgcagtgagctgagattgtgccactgtactctaccctgggcgacagagcaagactccgtctaaaaaaaaaaaaaaaaaagcctgtagtgatgtttcacctttcatttccacttctaataatttgagtcttctccgttttcttggttaatctagctgaagtgttgtcaattttggtaatgttttcacagaatcagcttttggttttattgatttttctcttttcaatttcatgaaattcagctctaatttttattattttgtttcttttacttaccttagatttagtttgctctgtttttccagtgtcttcaggtggaagtttgcatgaatttgagatctgttttttataattataaacatttactgctataaatttttctctaagcattgcttcagctgtaccctgtaaattttgatatgttgtatcttcatttttcattcatctcaaagtattttttaacttctcttttgatttctttcatttcttatttaggttgtgttgatttccacatatttgtgagtttctaaattcccttttgttattaaagtcccatttcattttattgtaatctgaaagaaaccagaatgggttcatatttttaatagagatgggatttcaccatgttggccaggctggtctcaaacttctgaacgtgggaggtggaggttgccttgagcctagatcatgccactgcactccagcctgggcaacagagggagattctgtctcaaacaacaacaacaacaacaacaacaacaacaacaacaacaacaacaaatctcttttcaacttattaaggcttgttttatggtctatgctggagaaagttccatgcctcttgaaaagaatgttcatctgttgtgataggtggtgtgttctatagacatctgtaatatttagtttgtgtgtagtggttgttcaagtcttttgttttcttgttgatattcttgtaaattattttatctgttaataaaatttgggtattgatatttctgattattattgtagaattgcctatttctccctttaaatctgttgacttctgtttttatgtctttgcgggctctgttaggtacataaatcatcacaattttatatcttccagatgtaagccttatttcatatcttttatagtcttctttccttcttgtattcttcctggtctttttagacagtgctggcactatacctgatgaagcagttttcgcaaacactttgtgaaaccttcttaggtttcaataatattcatccattagacaaaagccaggtgtttttgaaataacctcttctgtattttttggcttctacatagatggcagaggggaccacaccacaaagcttcctagaggtcctctggtttggttgagtagacctgtgagacacacttgatcttttttaaaattttttaattttacatacgtaacaaacctgcacgttgtgcacatgtaccctagaacttaaagtataataataataaaatatgtgtatacattatatataacccagttaaagaaaacaagtaatgcagttaaaaaatgatcaaatgacctgaatagatagacatttctcaaaggaagacatgcaaatggccaacaggtatatgaaaaaatactaaattaatagtcagcagagaaatgcaaatgaaaaccacaatgagatataaccttatatctgttagaataattaatattaaaaagacaaaagataacacatgctggtgaggttgtcaagaaaaaggaactcttccatactgttggtgggaatgtgaataagtatagccattatagaaaatagtatgaaagttctttaaaaaattaaaaataaaaccaccatatgatcaaggaatcccattacttggtatatatccaaggaaatgaaatcagtatattaaagaaatatctacactctaatgtttattgcagcaccattcataatagccaagacatggaatcaacctaagtgttcatcaacagatgaatggataaagaaaatatggcatatgtacatagtagaatactattcagtcttaaaaaagaagcaaattctgtcatttgtgacaacatggatgaacctggagaacattattttaagtgaaataagctaggaacagaaaggcaaatgctacataatgtcacatatatgcagaatttttaaaagttgaaatcatagaaatggagagtagaattgtggttactaggggctgggaggggatgtggtgaggagatgttggtaaatggatacaatatttcagttatataggagaaataagttcaagagatctattgtacaacatggtgactgtagttaataacgttttgtattgttgaaaatctctaaaagaatagatgagttttctcatcacaaaaaactatgtgaggtattgcatatgttgattagctcggtttagccgcttcacaaggtatacatatttcaggacatcatgttgtatatgataaatataatttttatttgtcaactataataataaacaaataatagtttatgacaggttaaaaaaaaaagaaataaaatctaccaagtgtgcattcaaacacatacatgtaaaatatctttggaagggtaaaaagatgctggtaatggagtttgcctctaggggaggaaactgagtagctgaaggattctatagcccccttgagatctttggtagatttgcactatgtgaattttagcaactgaaaataattaaaaaacaaagaaaaataaaaataagtacagtactcaaaaaatatttttttcatctaggacgttttttggtaatagaaaatatcaaatggaaaattaactagcaaatgtgtttttatatatgataaatatataatataagtacatatatttatatacatatatatttatgtattatatatgatatatatttttactgtggtaaaatatacataatataaattttaccattttaaccatatttaagtatacagctcagtggcattacgcacattcacattattgtgcaaccatcatcatcatccatttccagaacttttttatcttctcaaattgaaactctgtaccaattagacaacaactcctcatttctccctcccccagctcctggaaaccaccattctagcctgtgtggctgtgaatttaactacctcatataaatggtatcatacagtatttgcccttttgtgactggcttatttcacttagagtaagagtttcagggtttatccatgttgaagcaagtgacagaaattcattcttttataaggctgaataatattccattatatgtatgtatcacattttgtttatccatttatctgttgatggacatttgtgttgctttcatctttaagttactgtaataatgctgctatgaaaattgatgtacaaatatctgttcaagccccctgcttttactttttttgagcatataacaagaaatggaattactggatcctatggtatgtttgattttttgagaaattgctgtatcattttccacagtggttgcaccattttacattcccaccagcctgaactagggctccagttcctccatatcttcaccaatgcttgttattccaccttttaaataataatcatcctaatgggtgtgaagtggtatctcactgtggttttgatttgcatttccctaaggactagtaatgttaagcaccttttcatgtgcttattggccattagcatatcttctttggagaatcctctagtaaggcctttgcccatttttgaatggggttggtttttgttgtggtggtgacttgtagaagttcgttgttttctggatattaatctcatattagaaatataatctgcaatttttttctctttccatgggctacctttttactctattaattgtagtttttcttgtactaaagtttttaattttgatggaatttagcttacctattttgttgttgttgttgcctgtgcttatggtggcaaacccaaaaaatcactggcaactgcaatatcctgaagttttttcctgtgttttcttccaagaagtttatagttttagcttttacattaaggtctttgatttattttgagttaattttctatactgtgtatggtaggtgtccatttttattctcttgcatatggatatccagtattccccacatcagttatggaaatgactttttctcactgaatggttttggctcatttgttgaaaaccaattgaccatatatgtgaacattttcttctgagttctctattttattccattggtctttacgtctgtttttgtgccagttccacactgttttgattaccatggctttgtagtaacctttgaaatcagaaagtgggaattctccaaatttcttcatatttatcaatattgttttagctattcagggcctcttgggattctgtatggattttaagattaatatttctttttctccaaaatgtcattagaaactttagaagaattgtattgattagtttagatagttttgggtggtattgatatctcaaaaatattaagttttccaatccatgaacatagactatccttccacctgtttgtgtctttttcattttcttcagtaacattttgtagtgttgagtgtacaagttgcttgccctcatgattaagttaattctttagtattttattctcttttatgttattgtaaatgaaatgattttcttaatttctgttttcagattgttcattgctaatggaagaagtgcaactaatatttgtgtattgattttgtatcctgaaactttggtgaatttgtttatgagtactaacattttgtgtttatgtgtatgtatgtgtattttttagagttttatacatgtaagactgtcatctgcaaacaaagataattttacttcatccttttcaatttggatgacttttatttctttttttgcctaattgagctggctaggacttccagtgctatcttgaatagaagtggtgaaagtgagcatctttgtcatattcctgatcttagaggaaacatttttagtctttcaatattgagtacaatattgggtgtgggtttttcatagatggcctttattatgtttaggtagtttccttttatttctagtttgttaagtgtttttatcataacaaagtgctgaattttgtaaaagttctttatgtgtcaattgaaatgaccataggttttaaaaattttatccttttaatgtgtggtattaacttgacttttttttgtatgttgactcatccttgcctttcaggaataaatcctcccttgtcatgatgtgtaatcattttaatatactgtcaaatttggtatgccagtatttgttgagagtttttgtatcaatattcataaggaatattagttggtaaggttttttttttttttggtagttcctttggcttcataactcattctgtgaggctagcattgcctcatacaatgaattaggaagtttattctcctcttcaattttttcaaagagttctaggaggcttgttgctaattctttataggtttggtagaatttaccagtgaagacatctgagctttatttttatttttattttttggtgggaatattttaattattgattctatctcctcactagttataggtttactcagattttcaattgctttttgattcagtcttaaaagtttgtgtgttttaggaatttatccatcttatctaggtcatcaaatatgttggtacacattgttcatactattgttataatctttttgtttccgtaaaattggcagtaacactttcttttctgacttcagttatttgaaccttctttctttttttcttagtcaatctagctaaaggtttatctattccgtttatcttttttaaagaacaaattattgacttcattgatttttccctattgtttttcaactttgtattttattcatctctgctttagtatttactccattatttctgctagggttaggtttagcttttttcttcttttcttattttttaaggaatcatgttagaatgtttacttgaagtctttcttctcatataagagaagaatttagagctatacatttccttcttagtgctgcttttactgcaacccagaaattttggtatgttgtgttttcacttcattcgtttcaagatattttctaacttttcttgtgatttactatttgatccatttgttattttgactgtgttttaaatttccacatatttgtgaatttttctgttttttttttctgttgttgatttctaatttctttccactatgttcagaaaatacattttgtgtgatttcaatcttatttaaaatgtattaagacttgttatgtagtataacatgtgatctatccttgagaatgtttcgtatacacttaagaaaaatgtatattctgctgttgttgagtagagtgatctgtttatgtcatttacgtacaatagttctatagtgttgttcaattctctgtgtctttgttgatagtctatctggttattctatccattattgagagtgaggtattgaggtttcctactattactatagtgctatttttcccttcatttctgccagtatttgcttcatatgttatgagctctcatgatgggtatctatgcatctctaattggtacgtcttcttagtgaattgactctttttttaaagggtcaacataatgttctttgtcttttgcatttactttctacttaaagtttattctatctgatattagaatagccacccttctgccttttggttactatttgcatgaaatggcttttccatcattttacttctaatctatgtgtatccatagacttaaaatgtgtctcttgtagaaggcatgcatttggatcctgatttttagtcaatgctgccaatctatgtctttggtttatatattatttatatattgctttcctgattttctttagttctttatccatgttttcctttagcttttggagattatttgacagttgctttaaaatctttatgtagtatgtgtttcttcagagactgtttctagaaactatttctccttttaatgggtaagatttccctgtttttctttgtctaaataatcgtttgttgggaactgtgcacttgataaaatagccacttctcctaatttttgcaaattggtgtggaatacttctgctaattagtgatcccctgggtcttgagatcagcctggggtaacggcttatggtcttcatagttattttctgggcatgtagcctatctgagcctgtgtaagtgtgtgcttttgcctctttcttctgatgttccttggccactttcaaatgccttagtttttcagaaagtctcacctttttatcccagtgcctcaaatgttctaatgtattcccctatctataatcttttgcctcaggcacccatacgcctgcactcctcctttagttttcatgtgctctgttgcccaccaaatgccttccatggtttccaatcttagatctaaactatgctcttattcttgtgtgcttgctgaatcaggtaaaacagacactagtcctttgggcactctacaaccaggcaagaattttgaaaacgatttgcactttgctctttctgccctgaaggagagatcaggaattgagccatttctttgaccccaccaatatgggaagaggtgagcaaagtcaagtaaaacaccacagaatttttcctaccatttcaatgtgttttgtttgtttgtttttgattgggagtttggttggttgctatagatcttagactaatttccagagctcttgtaaagttgttttagtcagtctgtagttgtttatttagtgtttccatagggacaggggagtttggacttcctaatcagacatcttgctgatgtcactctatcctcttaatctttttagggggccaattttctgactaaatactggcattttgtgagctttttgacgtttgagcagaaggttctgtaatcacatactcagcctttttttttttctgccatgttatcaatagcttttcttgacttttgctaccttttcttttttttaacctgttgaggctgaaacttatcaaaattttaccagtttctttactgattttttgtttacttgtttgcttaacatttctttcctcattttatcgctctcctctctcattttactggaagttccagtagaaaccaggcagcaccttcaattcttttttggaaatctccttagctaaatatccaactttgttgctaacaaattctgttttccacataaccacataactgcagaagacaattttgctaaggtttttttttttttttaaaaaactaatgatctaaccaaggaaatttaagtttcctctagcgtgattccaaaaactctttcatccaaacccattccatgatttcaagttacccttacttttttaatatttgttatgtcacttctccatttccagtttccaaaatttattttagttttctattgctattaataaattaccatcaacagaacagattaaaacaatacctatttattttctcacagtttcttttggtcaaggggctgggcacagcccaacaagttctctgcttaggatctcataaagctgaataaatgtattattaagagtgcatttttatctagagctcaggggtctcttccaagcttgtttaggtctttggcagaatcagttccttgaggtgcccattttttggctggctgtcagctgggggctgctctcaattctgagaagtcaccctcaggtcttagctatgtgataaaatgtttacaagaatctaataatcatattttctttaaattctctcttacatataaaagttattaaaaaatgtatctcaaaggaaatgaatgctagaaattaaacttaggcaaaatgctaataaccgaaagagaaaataatgtgtatgtccagttaaaataaatcttgacataaacagtatcccaattatgatatatgcaggaggatattactacatagaaattagataagcaaaaaatacatttatagaattaacaaacttttgtaatactatataattccttttacataaagctcaaaaacaggcacaatcatactaaagtgatagaattaccctttggcataaaaaattttataagagctctgtcagaagtaaactggaagtttacttcttcaaagtgagcaggataatctgttttgattaatttaaaggcaactgattagcgttcttaatgagatctgtaaaatgtcttcacctttgtcatatgacgtagtttaattgtgggagtgacagtgtgtattcagggtctcactcacactcaaggggaggggattgtacatgggtttgagtcattgggggccactttagacttcttcctaccaaaacagtattataacaagctaaactgaatttccgcaacttgagcctctcttcatatttattagccatttgcattttctctttggtaacaatgtttttccttacctttacatataaattacatatttatttaagaatagtgttctaaatttattttcactaacataaactgcatacatcttatagtaaatggcacagatgttaattgtacaaccagatggatttttccatggtacatacctgcgtaaccaccacccagattgagctagaactttcccagtacttcagcaggcaccctcacatcctctccaggtcaaatccctcctcacaagggtaattgaattactttagaataattgtgcctgtttctgaactttatataaaaggaatcatacagtatatatagaagtctgtgtttttttctaagtattattttgtctctgaaattcatctatgtaattgcttgtgtaatttctatgtagtaatattccctgcatatatcataattggtctctacattctaccgtttatgtcaaaatttatttaaactggacatacacattatttcttttttgattattagcattttgcctaaaggtttaatttctgagcattcagttttaaaaaatattagttaacttttatatgtaagatcgaatttaatgaaactatgattattaggttctcataaacattttgttatcgtgagaagttagaataatttatgttgaagatgtattgcctatatatatcctctatataggatatatatatcctctttattatgcttatacatctgttttagaaacgataattttatgttctgaatttggagaacattattaaaaaacccatgtaaataatttggaaataaaacacgtgcaataaaagctaatgctatatgaaaaagagtgatgttttgaatttaagaaagaaccctgaagaaagaaaacttatgtttttattgccattataaaatatgacataaaaatgtaattttagttatcattcaaattataaatctgggaactgaaatgtatattatttaagaatcaatttaagtatttcattaccaaataagaagtaagtctaggatgcattaaaacaaatttgatatgagattgcctacatttgccaattttattatattcttcaaattcctcctataaaactccacatgaggcctcaacctaagtccagtttatgttacttagtagatgtaacttaatcacaacattagctcaggatattggacacagtgtgcattaatgtcttctaagtaaagtgatttagttgctttttgtgttgtgtgtgtatgtgatctacactagagaaattcaatttctagaatagccatttacaaaagcctttctcctcctattggtgccctcaaagattactcttttgttattgattcctactcctgggctgcacctgcctatgggcaccccttctctctacagatgccatatgtcttcagaaatagttttttaagggatagctctgaaataactcactccttgcttttctgagggattgatgaagacaaaataaaatataaaatatatactttttaatcatagggaccctagtagctccgtagaaatgagttatgaagaccgatgcctgcaactgcacttttgtccttgtctctgcaccgcagagtgtggaagtcacttcttcatggagaaagaaactatttattagctgcctgaagtggatcggacactatgataggcactttacatgatttggattttctcacttcatcattacaaccagtttgcaaacagactttcatatctctgttactggatgttatagagatgtgatttggatttctgggcagtgttgagagccctgttactaagaatctactatagagactgcgaactctaaatgataaaaatgctaaccttactgcgaaaaaaatgaaaactgtgcgatgagtaacaacaaattagcatggtgaaacctacaaaagaactgtgtgctaaatgttggaggaacatgtagcacagagtaaataactgctcagaagagctgagaggcttccagaggagagactgtgtaaacagaggctgtgtgagtgctgtaccatggccagtgcccatggggccagcttttactctagatcaagtcaagtggcatgaacacacagagtgtcccatcccactgccgagctgctgggttgaggaatcaaccagtcaaactctcacgttgcccatgtgtaagcgcttcaagaaaatgacttccccagttgtattatgacttccccaagttgtagttgtattggcagcttgggctgccaaactgccacagactgagcggcttaaacaacagacattcatttctcacagttattttctaaacctctaaactgaggtttagagatgttatctgatttgcccaaaccctcacgaggttcagcatgaaactctcatccaggcacaatgcctatatttatcctctttcttatggttatacatctgccattgcagtccctttgggtccttttttaaaataattttaataatttttattttttgaaaaggcttttccaaggctcaatatacataaatcattgaatttataatgtttagtatatattaactgcttagtgtaatgtttagaatatacataaatcactgaattaactagtcagcttcctgagaaatttagtgatctcacaactgaatgatgacctggagagtttgttacaacacagattattgggtttcacccccaaatcttctgactcaggaggtccaggatggggcctgagaacttgcatttctaacgagttctcaggagacgctgctagtccatgcatcacatctggagatacactgccttggtgtgatggaaaaagaattctacttacaatcataagttatggggctattctctcttttattggccttctagctgtgcgctggtggtacggactgaactgtgttccctgtttgttgaagtcttaaccctcagtacctcagcatgtgactatagctaggactttaaaaaaggcaatgaggactaaatgacatcaaatgggtggatccttataagaacaggaaatgtacgcataaaaagagacaccagggatgcacacacatagagataaaaccatgtgagggagaagaaagccgtcggcaaaccaaggagagaggcctcaggagaaaccaaccctgcccacaccttgctcttcttggtgctgacaactgtgagataatgattgtctgttgtttcagcagctcagtctgtggtagtttgtttggcagcctgagctgactaatacaactggggaagtcacttccttgctgagcttacacatgggcaatgtgagagttcggctggttgattcctcaggccagccacttgacaatgagatggggctttctgtgtgttcatgccacttgacttgatctagtgtaaaagctggcccccacgggcactggccatggcacagcactcacgcatcctctgtttacaccatccctcctctggaagcctctcagctcttctgagtagttatttactgtgtcctacatgttcctccaatatttagtacatgcttctctcacaggtttcactttgctgatttgttgttactcatcgcatggttttcagtttttcccagtaggtttagcatttttatcatttggagtctgcaggctctatagtagattcttagtaacaggactgtcaacactgcccagaaatttaaccatgtttccctggccaactctcacttcttgtgccaagtcaatttcaaatgtcccctctcctcgtgcctccggttcctcctcctcccactcccattggaggagggagttcctgcctcagaaagaaaataagagtgaataaatccatccacctcccaccctctcccacctgcatcctctttccttcctgttacaggaggaaacaccctctttccttcctgttacaggaggaaacaccctctttccttcctgttacaggaggaaacaccctctttccttcctgttacaggaggaaacaccctctttccttcctgttacaggaggaaacatcctctttccttcctgttacagagtagggccctcttcctaggtgaggctgatttctttgccaagatgaatcctttcccacctttgaaggaagaattcattgctctctgttttcaatgcctccccctgtcctgaatctttctcactatggattatacatgctcatggctcttcttttgctaaagacaaagcagcataagagaaacaaaacccttccttcaaatcatttccctccagttgcctccatagctctctcccctttacagccaaacttctttctcaagagttgtggagacaagctgtgacttgcatcgtcgtctctcacttgagcctcggtcaactcagatatgtgccattttcccaccatcccactcaaaaggcctgttttaatttcactggtgaccagcacatcactagtttcaaaaggcatcatcctttatctctaagctgtatccagcatcctctttttgggcaaaactttatttctttggaccctatgacacatcacttgttttcccctgagtacttgtcttcacctcacctcctgcttcatcctgaccttcatctgttagagttctaccatgctcaggcagtccctgagctctcttctctctttattcttctgaggggtcattttgtccctaactgaggtttccttgttcccatactgctgctcatacatctggggtcagctcagatcacctctcttggctcttggctataactgcctgctgagcaactccattctaacgcatcccaggtacctccatctcaacacgtttaagtccaactcatgattttaacccagaaaactttcctctggctcattcttggtcttagagaatattgctgctctctacctagtttacaaaccagaatgtcagagttattcatgagccttttcctcttgccctccatatgtagccatccctagattccatcagggcatgctctacactgcagccaagtctttctttctttctctctttctttctttcttttttttttttttgagacagagtttcactcttgtcacccaggctggagtgcaatggcgagatctcagctcactgcaacctccagctcctaggttcaagcgattctcctgcctcagcctcctgagtagctggaattacaggtgcccaccaccatgcccagctaatttttgtatttttagtagagatggggtttcaccatgttgatcaggctggtcttgaactcctgacctcaggtgatccacccacctcagtctcccaaagtgctgggattacaggcatgagccactgtgcccggcctagccaagtcttaagaataagtatttgatcacattattctcactcccaaatatttaatggtttttcatcttctgggactcaaattctgctcatggactcctaagatgatagaaggattggatcctgactgcaccttgtctatgccagttggactcctttcagtttcttaaacagatcaagctccttcttgcccccagaatctttacaacagctcttctccctgcctggaatgctgtctactctttcccccttctctgagctaatctttgttcattcttcagtacgtgatttatttgactcttctgcagagtcttcttcaacttgccagaccaagttacttccctcctgataaatgctcatgctcccctcttatgcttcacagaacctgtggcaggttgtatttaaatagctaattgcaagtgtttaacatctttgcccagtgaaagaatgcaaattcagtggagctatctcgtgtgtggctgtatttctggcagggaatgcagtgtctgtcataataaacctggaatataggtttcttgcctgactaacagaccagctgaatgagaagggacacctgcatatcaaggcaagtggtaaccacttggccttacctgggttctactctagggcttctggaatccatgtatcactgcacatatctggcctttgcgggctctgtcccacctacagagtgaacagtcccacagtgttggccacactgatgtggccaactgatgtggtcccactgatgtaccattgctttggttactttgttcggaatgtagttttaagagaaggggcctttttaaagaaagtttaaaaatcacctgggtacttagtaagatggcatattcttaggcctaactttcacaaatttggattctaaagacctagacatttacattaaggagcaccccaagttccttgatttagatggtctgtggccactactatgagaaacatcctgttagagtatctttaagctcaaagtttatgtgaaagatcacaaatctatctaatactgagtgatttggggagacatgattgttttctttatataatgctttgtcatgccctttaaaaaaaaaaaaaaaaaagaaaccttattccctgatgtgagacctgagattgcatttacattttcagctctatgatctgccactaccactttacatacagttctgttccttttttctcccacaatttaattctctgtatttcatttctaattactgcttcttctgatgatggaaagcaattttggcagtgattaatttgaagggtctgcaacctctcctttgctttttaagacaattctatttgcacagcccatcctatgaagggctagtagaactctgcctcttcagagggctgttccaaattttttgggtgtctccaggcttaaccatgatgctaatcctagagtgctgtcttttcttctttaaccaaatttcctcaaatttcaaaaaccaccttccctggaagcaaggtgggaagggacatggctgctgccaattatgcaggccaaagaaagtttgtgttccacattagctaaaagcagcagaaagctaatggcagggtgctttgcagaaaagagtctgccaaaataaaatggaattgaaatagatttgggcaggataaatgctggtggcaggtgccagaaagcagcaacttctgtcagaagcagtgaaaagagaagaaagtgtgtgtaattcttgcagccatgcagatcagagctactaaataaacctcctgaggttaatgataaatagttccaaacctcatctcctgtactggaatatcatattcctgtgagatatttaacaaaagatgagattaactcatcttaaatgcagtcattgcctcaaaagtgggtaatgcagacaggactagctctgagcaactttcactaacatatctacctccaggaagctaaggataaataggcccttgaaagcatcttcaatcctgtttcaacacccacctcctcacgggagcctaggagagttgggtagggcatcttgaactggctccttcaattccatcttcctccctactcccataatccatttctttctccctagtggatagagatacttgggaatactgtgagtagctgcatttatctctctttgaaccatggtacaaaatcatgactttactttgttaactactttaactttgttgtttttaactctgaaaatcatgttgcaatgaagccccattaatgacttgaaaactgctcctgaatgaggcccactaggcatggctgtcaaagttgagagtgaaatcaagaggttaaaggaactgcagaggtggtattaggttttctgaggaggggaagaatggacccaggagagagagaagcctcacctcaggaaggcaatacatagatagggatgctgaatacaatatttggtcaatatccatccattcaatcacccatcagaccttactgagcatctcatttgggctggggagtgagattaaagctgaagatattgagatgaatttaaattaagctccactctttctggtttcaaggacctcagcgcatatgaagaagacaggtaagtggaaggtgataggaacagtgagggagatgaacattgggctcaggttgaagagaagatttgatagtagggaaatttttcttctttttttcagctatatttattgaccctcacttgtgccagatgccaccgtaagggctcctacttgcattatcatcactaacttttccaagaggagctgtctgagccagacttccaatgggcagatgcctgacaacagagtccacatgcctgcctgcatagaaccttgcctcccaaatgtgaccaaaatagaaatcagagagcagggttaaggctgagatcataattatggtgcagcaaaattatctctcgccctaaccatcaatgacaaccgcaaaggaagctcaggtttggaaactcaagtgtgaagctgtttagagactgcaggaagacctgtctttggtgcatatttagagtttaggtgccttgaccaggtagtataagccctttagtgatactgatgggttcataccacccattcaatatccctgattccctgaatgtcaactcactgtcttttcagtataggtttaatcaaaagtgtttcagcaacctttattcaaaaatgtggctgggtttaaggtatgaccttattcacaagtgaaatactaatttgatcttttgacattttggctattacaatcatagggcattgcaaagaaccaaatcaatgatgaattagccacataggaattggaaattttaatggcatgacatgtagcatttttcttttacctatattgtgtttttttaagaaaaattacatttgaaaaagcagtatggttgttataagaaataaacagataaagtatcacataaattgataattatgagattatcaataaaacagtttagataaatattgcctccacttattagcttctttaaagaattaggcttaatattgattttactttttaagaatatatttaattaacctagctttatttatttatttgagacagagtcttgctctgtctcccagactggactgtagtggcgtgatcttggctcacggtaacctctacctcccaggttcaagcaattctcctgtctcagcctcctgagtagctgggattacaggcacccacaaccacgcccagctaatttttgtatttttagtagagatgggatttcaccatgttggccaggctggtctcgaactcttgacctccagtgattcgcccaccttggcctcccaaagtgctgggattacaggcatgagccactgtgtccggctcctagctgtctgtactgccatgtttaataaataattgtttttcaggttttatgttttgttagtaagcacccacatgccacaaaaacattcttttattttcttttccttttgatttctctctattccctttcctatttcctctctccttccttccttcctttttcttctctcctctcctcttcccttttctattcttctttaaaaataagatgtttgattttattggctctctacttggggaaacaaaaatgttttgaataagacaattcagtaatggtttggataaatatcatacagctttatatataccagaacaaagattgaagagtaccctatctaacagggaagaaaattacctgtccaaaatgttcagtgtattcagggttagccagggctggaattcaggcatcctgatgctagagtgtgtgacttcccctgtgagacatttacaaagttagtacccatcttaatggtgtctgcctattgaattagaagtatatttcccaaggaaacctgtagcactgttaaggtttccatgcagctcacctgattctatttccctgacttggtgagacagatgcaatgatttatgtcttttcatgtctgccaattattctgaaatccagcattatgactggggtcagcagaaaatagtcctcataccatttctgtaaccagcttagcatatttctgtcccataatccatgtctttgcatgagattccttctatttcttcacactctggttaccctccctacctgtcacaaacatgtttttatttttgaattgctggcattggctgactccttgaagaaacttcctctaatctgacattatgtatatttcactgtgctgttcaggtttcactgacacgttttgtttacttgtttgactctattacaagaccaagaacttctcgaaacccttcttcaaatagataacccagcacctagcatagcacttgcactagtaaatactcactgaatttaattccccaaatttaactcatttcacaacctctcttgaactggatttatttataaataaatgaaccttttgatctacattagttcagagagccatttcagcactagaattctgtaactcactgaacagagaattttactgtttctatctcataaaatcatgctttatttcctgaataagtgtacagtctttacaaagtaatttatcgtttacaagatgattaagtgttcagtgctgagaaaacccagaaaattgtgaagaagaataaaagagtcataatctcaccacaagaatataaatttttaagtaggttaaaaaatgcttataccaccttcgctttttaaattaaaaccttccattttatcaaatggcatgtagggtttatgaattattggataaaatgcaacttttcactaaaagcatatcaaaatattattttttatagtttaatattagtagttttagcaaattatcttcattctatatgtattactttgcaacatttttcatctgatatatgatgagtgtcttcctataatttcatatgtgatgttttaaccctccctcattttttggttaatacacgctgttaatacttgggtcatattccctctcccactcattttactgagtcacctttcatgttcatttttcaaaagactgtataatttcatcttaaattgctttattcacttacaaaatgtaataaacattctctatgagtatttacctatactattaccttaagcagattaatgtattttactacatccttgtattgtaatttgttcagttaatacctacacattaaatacttgtttcttgcctcttgttattatattcttttttttttttcttttctttttctttttcttttttttttttggagatggagtctcactctgtcacccaggctggagtgcagtggcgtgatcttggctcactgcaacctccgcctccctgtttcaagtgattctcctgcctcagcctcccaagtagctgggattacaggcatacaccaccatgcctggctaatttttgtatttttagtagacacagggtttcaccatgttggacacgctggtcttgaactcctgacctcaggtaatctgctccaccttggcctcccaaagtgctgggattataggtgtgagccatcgcgcccagcaagatgttataaatcacctggtttatgtatgtgatgaaattttattttattatttataataaaactcttgtattgagataaagcagatcaaaggcgatctgtatttgtctccaacagaaagactatatggacctgttctcccaccaggaatgtataagaagatccgtttccttaaccctcaataatattagatgttaacattatctttaatctttactatattgattagtttaaaaactaaattattgccttggattacaatatttacatattggctattttgtaaatcttttattaactgtatattcctgaacgttgtgtgcccattttcttttggagttttcatcttaattttactgacttgaaagcattatgtttgtaaagctttattataaaatcttcaagaacacttggatgaactgggtagtgtggagatcatattcttggatgcttgctgagactttgatatttaagctatttctcataggtgttaatgtttgaacaattgcagccaagtgaccaaaagaaaaattctttggacatttttcccaagcaatttgatggtcaggataaatgggaatgcatgattatggatgaaactagagtccttgaatataattgcactcataagtcaaagaaggcaattcataacaatttggcccagcattttaattttgtctgttaaattattcatgcgaatactttcatgagttaagccatgaatatttgattggtggttgattcataaccataaactatattagccctttatttttctcatttatgtccaattaacatatacgggaaggtggagaaaatttattcttcttaatatgagaaacatctttccccacagacttatcgaggctgtctgatgaacatttactatgactccgggtcaacattacgtttattctggcagtttaataactgttctaataataattctcattacatagagggaaaatattacaaatctctactttacaagtgaggagatgacattcagagaggttaaataatgttccagaatccacacgatatgttggtggctgagattagattcaaatccaggattaaaaaattgaatgttccccaccccacagtggctctgatgattgttctcaatgaacccaggccagtgtgcacataaatcaccactctctgagtctactctattccttttctgttaccagagctaattgctaagtagatatccaatacttgtttagtcatgtcagttttgtatcacttaacaaatatctcttctgccaactaagcaggtatttacagccatttccctgctgtacacaaatatgagaaggtgcacagtttggcaggtggctaagaatgggtggctagatgtgaatgtcaaaagctgctacgtaaaggctaatttgtaggttgtgacatttggtgaactgtggctattcagttccttttaagcctgaacaaagtatggcattttaccttgtcagagaaagagcttcttggtcaaagggctgtgaagatatcaagtaattatttcagtaattacttttagaaatccagggatgggcacccaaaaacatcccagttattttagcttgagttagagaattcaaatacttatcctaataaatatgcagacttaatagaattggtgttatccagcactataacctcataaaatcatcaagaagagtgtatatacttgtatgtgtgtatatatatagatagatagataggtagagatataaaatttagtttaatgacatacttttttcctagcaatataatctgtctatatgctgacttaataactgctttatgagagctgtatatggatcaccattgataaatgcattaaatcagtggttccatagactggctgagaatttcaatcttctgggaagttataaaaacacacttttaactctgagtctctggagattgggatttttttttttttttctgagatagggcctggcaaccagcatttaaaatgttcccaggttaatctgatatgcagcctggtttagaaaccactgctttaactacctaatgcctcatcctcattagaactttattcattaaaattaaatactaatttgccttataatttggaagtctaacatgtgactcagcccaagtgactactgggtttggaagtcttctgtccagcacaaaccctgaaatccttaaaaatgggtgtgcaggtctttcttgtcttggtttctgatcacttttaactctcatctcctgccacttgctacacggatgtgccacattctgtttccttgctattcacagagaatgccaggcctatttatacctcctgttttgatctttagacttccacattttcttgtctgcctgtaaactcccagggatctcaaggattctacctgaacgtccgggccgcttggcctgtttctcactttttcctcagcatcccaaggactcactccttggtaccgactctttccagcctgacactttgttacagtgtgctgggttatttctttacatttttatctcaacccgtatgttggggacagaaaccaaagagcccagcgcctgcacacactgggcactcagtaaatatcccaaatgaagttttctcagatatgcatttttatccccatgacccctctacaattctgttctcaatgctgtgacaaatgatgtctctttcacatggtacagcttctttaaaaatgttctcttttgggtcttcaaacttgtttgctgctctctattaactgtatttcagtttggtgtttgtgagcagtacaatccgtttagtacatctgttctttataagactgcctttcttgtgaaatacttcatattggattttctggagtactttagagtcaatcactgggaaaaactatcaccacagctgattgatccggctgagtcctgctttggacgtcgtttaagactgcagtccatgggctacctctgtctctgctcccagcttctcatccacccagtggacagaaaagctgctctccacagcttgtttggaacgtgcaacctcaactccaggagatttactgagattcgttggtagaggctccaaaggatcactcttgagggagcgtggccggatgatcagtagatgaatgatgcacagctcacgctttcctttcgaattttgcttgtggatcgctctgatagctgaggatgttttcacattcgctgcgtcccccagagcagggaagcgggagcagggaggcgcagtgggcaggcgccgggctctcctatgccctgcggggaagtggaaggcgccgggaggagcgggggcggggtgcagggacggtggaactgaggaaaagcaggccgtggggttattccctgaatgaatcccgacccacacataagctggggttttcccaggagagacctggagttaagaacagagaggaaaaggatggtgggagagaggaggaggaagcaaaggagcagcccaggtgtgtcgtccgctctaagcgcagcggagctcacacgccctgctcctgccacgcgttgccacgaggcttcctcttgcattgcagccttccggcccaaggcccagcttccgcactttaggtgcataaaggggacactcaagggagtcctcatggggtgggcctgcgtcgcattcccatggctgcgagatgccgcagggtcaccgagagggcaaacgaggcaaagcgctgtcacctccgcagagctgacccagccgcccttcctcccgcccgtcctgcaggtggctccctagcacggcccgcaactgtgcagggcgtccagctgctccgcgcacaagtggccgcgatcctggcccggaggctccgccgcacgctgcgcgccgggaagagcaccctcgccgacctgctgctgccagtcctcttcgtggccttggccatgggcttgttcatggtgagacccctggccaccgagtaccctcccctcagactcacacctggacattaccagcgggccgagacctactttttcaggtaagttgtttttgttcctttgatttcgaaattatgtcgaggcagattatgaattgcaatagcttcgatacttttgagaattctagataaaaactggaaatataaatgttttcattatttccgaggtctgaattcacgaggagatccttggagaagctcttgctcctctcaggctgtctcagggcaggcgcttaaggctaatgaggctgcctggtctccgaatcctgagcccctgacccctcctcatggtggccgagtccctgcgcgaaagggcgcaagctgtcacccgccgacctgcagagggcccagcacgccctgccccacaggagggcgggatagactccgggatttgtaggattctagaacgtattagatatatgtggtattttcacaaagccctccacagttgtttctgggacaacagccccacagttgcacacacctctctgcggagaaacgtatgacagcacggaagggatggaagccctgagcctccccaggctggggtcaattgagcaggatctgttgccggtgcgttcagaagagcctgggtttttgccaccaaatgaatttacgcaagaactcagagctttctgggttgcagattcatacacaagggttgggaacctaagatagaaaccgatcccctaagttcctttgccttagtttagcgggctcctctctagattcaggagaatctgtgcagagtcagggaggcccggcccttgccgggcacggccatggctgtgatccagacatcattacattgaacatgcaaaatcgtcttcaaggtggctacaatttttcacatttgggatggggagacaaatgactggaactcagtgatactagtttacaactgcacaagcatactggctaggcttttcaacatgaagacaactaagaggacagtgtcagttctgcttttgtcaaatatatatgcttactaaaataagcagcttaaccagctaatctctaagagcctactaatatgtgtgtaatttttgtagtgatgtgtaatttggaattagatttaaacaaatacatggacaaagtaaaaatctatggtaaactcttcagtttgttccctccttgtcacactcctcaactataaaagggctatcactattttgagtcttttgattataaaatatgtttcttgaagaaaataatacaaagcacaggctagccaaaaaataaaataaaaaacaatcacatgtaattttaccagagatatctacagtaaacctactgggataatctgccacatgatatacataatacttgtatctacatgcatttgtatttgttatcacaatgagattacactgtaatactctctgtaactcttttacactccataatatctttgtatctcttcttataaatcagtacaaccactttactcatgaaaactacagtaccctgactactgaatggctctttagtagtatgttgttggaggcacattaatttatttagacagtctctttttgggggcatataaaggtttatttatttgttttttttttcctattataggcaatgctgtataacaatctttatttagttagatttaggtgactatctacttattcttaccatcagacatttctattagaattttggggggcaaaggcatcagtatttttatggtagatagtgccaaattacccttataaatgtgtgccaattaacagtcttataaagtcattgattcttttcttcaacaaatatttatggtgtacttactatatgctagctactgttctaggtggtagttatatgtataattagaacaaaccaaaacccctagttttgtgggagaaaggaagttcagttctctaaactctaaaagttttgatagttcagacctgatatttcattgcttaataggcagctctttgattactattgaagttgaatattttcaaagttttttggttatttaaaattttactttacatattgaatatattaagcatcatctatatatatataagtgtatttccacatcatattttgcttctaactgacttcttcaccctcctcccctctctcaactttaccgcttatctttttcttctgagaccgctgagaatttcccttcatggtgtttatttcactgataccattttcagttgactccagatagccattcactttctctactgcattgttaatttggcgattatgtttttcatttgaaagcatttttcctactctcccagtattcatttgttatagaagtgatgcacttcaaaattattttgagtctgagaattaagatattttaatattttcttctatttctaagagttactattttaaattgagatattggtttgttctcatttttcataatgttacttaacttatgaaacagagacattcacatgtctggaggtttattttctcatccttacaaaggagtcctgcctacacaggctatcgtacctgttccatcagtgattgcaagtgccccacttctcatggttaatttctgtctaaagagaaaagaacaagcttacattttctcagtttttattttagtagagtggtagtttagttagttatgaggaaaaagtaaaaagctaccaggaagcatccacattgatggaacattttcttgcttttttgttattatctctaatgtttgcagtgatagtcaaaaattagtgggcgagaagaataactatcatcatttgatcattttatgggtgctataactgctcttgttaggaattctccactgacattcattacttttcttctgcatactggatcctctctgagtgtgtaccttgatttctctgaagacaacccctgttgttttgcatttgtattaaacttgcctctttccactctcaaaagtgccctcttatgagtgataaatgatgtggccattccttcgttattgaatctgagcaccatgatctaaatcttggcacaggaatgattcaaaaggggcccagattttcacatcttatagtcctcctgactccctgtgtacacaggccacccgtggtaacccagcacccatccttgctgctccaaatgtgggacaaccccattttataacatctgtgagcagtctccttgggaaggcatataagattgccattacactccctctctttctccttagggtaactccctgttgatagatgcataattcaggcctgcatgtggctttcaaaaatcatgaatgcattagctttgtgctgatttggaagatacatataaatcttatcttattagtgttctgacaattctcaatagagccccatgcttctaaaattttagagttgagaaaatgcaattatatatctacattaaattcactgaaaatttcttgcagaatacaaatcttcataaaagcacaaaccagaagaaatgcactagagaggttcttttctacctgaatccttctacaaatgaagggaacagatgacacccccacagctcatagagggtttgagcttcttgggcccaaacaaacctggggctttggcaactcagtctgcagtgttctccaactcacatgctttggtggccaggtagggagtgaacgcatgacatccacagggctgtaaagatgcttgttttgtaaccagacctccacagcacattgactttatagactgtgagggaggaggagaagtatggagcatgtctgtgttggtttggggtctggtcagccattcatgacccaggcttctgactcagttttgttctgaatcaacttgctctgattgctgttttgagagtgctccagaaattctccctccccactaagaagtgtgagaaaagggtggcagggcctctgtgcctgtttagggtggaggcgagcagcacagagcagccccagagaaattagaggagggtggtgcatctctgagagatatagtgtgaacacagctgcacctgcttgcagacatctgaggctggtaagacctgacggacctgctcaaaaccttgagcagctccatattgcccaagggatgatattgccacatcttagcatatcctacaggtcctcctggtgcctctgcagcctctgccactccctttatctcatgctctgaacttcagaatgacacaatcatacatgatgttgctgcatctctccctgtttaaggaaatggaaactaccttcctctcctcagtcctctgccactcccactctatacactctaatgttcccagcaaaataagaatacttcaaaacccggctcagatgcccccttccaaggatcctctgtgcttgctctctcatctgaatgtctgtcattcctgtgtggatgtcactgtggcttaacttagtgcgggagattcttgcctttcttcctacagggagacttcctggagcttaaggatcaagccttctttatatctgtacctttagttcctgccaacatgtctataaatgattactttcattaaatccttgttaaattgaaataatgaaaatgaaatgtatcaaaaatgtcttccagaaattaacttggacaggcagcagacaaacaaatggagcatagaaagacagctctctacacattaaaaatataaaatatttaggctccatgacctcatcttctgggatggggctcttagtccttactagaggagatggtcctaaatataccactagttcactgcattagaaaaacccgtgagccctccttgaacatggacctgaccctggcccactgtctgctgagtttgttcctacccccaaactctctctctttttctcctagttctccaactaggagacctagaaaaagacctagaaggagcaagtgtaggactcccaagtcctggttgctacaccagttctttaagaacccaagagggccagtggatgtatgtggccagtcggtgcccactgtcaccatccccttctcctgttagcatgccagcagaaactgggtgcgttttttagttttctagggctgctatagcaaagaaccacaaactgggttacttaacagaaatgtattttctcactgttctggaggccagaagtctgaaatcaaagggtcagcaggaccatgtcctctctgaaggctccaggggagaatccttccttgtgtctctagcttcagtggctgccagcgatccctgacatgccttgacttgtggcagcatcactccagtctcagcctcctgtcttcatgtggccttcctcctgcatgtctctgtgtccacatttccctcttagaaggacaccggtcatattggatatggtacccactctaatcctgtatgaactcatctaattatatctggacaaactcattccgaataagatcactttctgaggttctgagtgggcatgaaatttggagggaaatcattcaacccacaacatttcctacaacatcttccttaacaaataccactaaatttgaccaatctcttggccacttgcctacagtagaatcacttggtgttctgtaaaactcaagcttttctgctatatgcagaaggataacagaaattaaattaactgaagactgacagtgattgttggtgtatatttgttggtgttctgtcatctcaaaaacatccaccaggttttgcaaaatggtcaccgggatgtgataaatgtatacttcatgatccagtgatgttaacattcatagagaacatcttcaattatttatattcttctcctcatatatgtacaacttccttctatgtatgtggcatctttatcacatgagatagtagtgattgcttcactttgtttcagtaattcagtgagaggacgaatggaaagtaattggacaattgtttggaagaaatataatgaaagttatttttcttcttattcttagtaaatactaggatggacctaatatatcatctgtgcttttgagcgggatggagaggatgtagcacactcaccagcaggctcttggaagccttttttctggcagaataacatacaaagtgctggctgcccctctgatctcatttcctggtttcccttcccttgtctgcaaggtccgccttcacaccaggcttcgtccaggtcatagaacatccaaactctggaccgactttgcatgtccagttggataccccaagagcattcttcctctcagtcatggcacagaagctgctttctcaatgtaactcgcccatggtccttttacagtccagtgggaaaaaacagatggtaaatgaaatagctgaaactatttgcttgacttaattatgtatacattgtatggggacaaagtccagcactgagtaggcatttttaaaatgtttacccatgagtgaatatatatccttcatgctctacccaaccatgaatttaggatgtacttcatggcccctcaccctgggtgaactgttcttcagctcagcccacctgagattcagtaatttgtgaattgctggtagtcgtacctcttagtgggttgaaatttaagaaaaaagagagagaatccctgatgacgacattctcattgtggacagtgaactcacagatgttgggtgaactcctcagttggcacaacctagccaactagccaacaggactgagaatccatttcaggcctcctggctctaattctcattccacaaacacttacaaggccataagttctaccctgagaaagtttacagtcaagcagagaaatgatccctacaaacagatgggaaagtcttataggtagatacttggtgcaggggttgtgcataagccacatggggagatatttaggggtgtcaaagaaggttttttaaggctatgccccctaaattgcttcttctgagataacaggtgttttccagacgtggagaagagaaagtttcttctcttgtactctctctaaaggaagagtgtgagtaaatgtgaaaagtaaggcaggaagtctagcagaagccttgatggtttctggcaggtattacggtattataaggcattctgaggagaattgacattatcttgcaaacacaatgcagggaggcattaagaagttctaaagtctggggagtgatatgagggggattatttttgtagcttccaggtatgaagtcttatttggagcagtctatctgagtctcttcccctcataggtaactttttctgtctggaattgtgcaagatttcttctttatccttggagtaaaggattcccccccccctactgtttccttatcaaaactgcagatttaagtctttttttcagttcagggtaatttttttggggggtgggggagtacagggtctcactctgttgaccaggctggagtgcagtggcgtgatcttggctcactacaacctccacctcctgggttccagtgattctcctgcctcagcctcccgagtagctaggattacaagcatgcagcaccacatctggctcatttttgtatttttaatagagacagggtttcaccatgctggccaggctggtcgcgaactcctgaccttaggttatctgccggccttggcctcccaaagtgctgggattacaggcgtgagccaccgcatcctgccagttcagggtaattttcttctattattaatctaatttcttcacacccatttttcctttacctccttttagaactcctagcacatctcatgttagggtcttccaaatccatcttttaattctttatctttccttaaggatttctttttcctttttgtcctccttctgtgtggatttttcttatacatcactgtttgtatctaaacagtggctatcctcttactcaatttatacctctaatattatcttcaggaaaccattcttcttggtttgagaaagtcctgtgtaggcatgtgcttctctgtttttttgttttgttttgttttgtttttaattttaaagtgtgtattcctgcagcacctttatttttcataaatattggcactgtttgggtttttctctggttgctgggaccccaggacatgtgtttgttattgctgttttgacagatcagataagtatgttgcctatcaactggacgaagttccgaatcaaagcacattctgcctctgtagggcagcagctgggctgccagtactttctgtttttttcagggaggtggggacctttgcttcctatactctctctcatttaggaatagaaggcatcagctcctttaattaagctttttcttgactattggggtccagcgagagaggggaggctgaggtctctggagatttgcaggtctctgagggccacacctcccaggatgggtcctttctggtccttttccctggatgctctgctcctgttcttcacattgcattcatatgtggcctggcctgtagagatgatggccctgaatttgcttggctagtagcaaatcccatagagcccaagacctcacctggaaccagaaatttatcaacaccaaaagctggttggatcaggagaggtcgaaagactggagctgagagtgtagggaaggaaggaataaagaaaggaaaggaaaggaagggaaaagaacggaatggaatggaatggaatggaatggaatggaaaggaatggaactgaacggaacggaacggaaaggaaaggaggaagggaggaagggaggaatggaggaaggaaggggagagtgtaggctgctgtcttcccagatgccccagtgtttctcaaggttggtttgatccttgtctaaatcagaaccactggggggacttgttaaccaggaaggcccattaggagtgtgtatttgttcagccaagctccttgggtcactctggtgcacaataaattttaagagatgattattagagagagtgattccatttatgaagttcctcgagaatcataggtagtaattttcaatttctagagtctagtaaggacagatgtcaaatgtttctaacatagagatttactttaaaatatagccaggagtttgaaggcaacaaaagagggatagtttaggaaaaagcatttgaagtttgtggtgacaaagatacttttaaaagaagcttgcatttcctaatttgttagaaacctgaaggctgtttatacagaggtcacactgcctacttatgagacataactttgttgtaaatttcagcaagttccatcattgtgtgtttctggccacagctgtagggaattatattaggacagttgtaaaccatacgaatattttaaaatctttattaaattttatgcagtggggaagatagtgtttttctgtaaacatttatttctggatttggatgccacagaggtgtttgcattttaagttgctctggaaacaaagtcctcctcagcagaaatataatactaatttaatgtaatgagttgcatttcttctcaattaaattttgtttttgtttgaatggtaaaagttcagaaagggccagatttagggaagtaaaataattggatggagattaaggatgaggccaatgaattcagtgcattgttaacatatcacaacttggttcgacacatcatttatgagaccctgagttccaacacctatcctaagcattgtgccctttcctcaaggattgcttcattccagtaatgagaacaagggtaagcctccagttaaactccagtgaagatgtatactaaggccaccaggcaggacaaatggagcagaggaggcagggaggacttattatggaatcggtgttccaaccaaggtttccaggccaggctggagatggcttccaatcaagtgtccaggatattggagataccgagacagagggatcagcaccctcaaaagcagatctgcccaatcaaacagtggttctcctggtctgggctgcgctggctaggctgggctgggtgccgtgctcaggaagaaatggtgagcaacaggccctaggattgtggagggattcaaatactatttcaaaacgcataggtaacaagaagccattgatacattttgagcaaagaaaatgtcagattggtatgttagaagagctcactaaaggaattagagaaattgggagtctgtaatgttccattctatgtgtacggtcacactgaacagtagcctaatgagaagtttcttctcattctgagcttacgtttgttctgcaggatgtggttggaaattcctacatttccacctcagacctttctacattttaatgctaatagcaattcagaaaaatattttggactcaattatttcttgtctgagaacaaaaaattaattagagaaatcagtggttacagattgctctgtggttgcttacatttcttctttctttttttttttttttgcattttctgttttaaagcttttttattgctcataataattatacatatttatggggtacatgtgatattttgatacatgcgtacgatgtataataaccaaagcagggtatttaggatatctatcacctcaaatatttataatgtcttactttgggaacatttcaaatcttctagctgttttgaaaataggataaattgttgttaactacagtcaccctgctgtgctatcgaacactagtacctatttttttttataactgtatgtttgtacctattaaccaacctctttctctcccctattcttcccagcttctggtgtttgcatttcttcaatgtagctaatgttttaagttctttaaaaggagtcacttatgtatatttgttaatttatataataattctttccaaaaagaattgaggtcaccaggtatatctatataatctataatgctgattatataccatttttgaaatttttgagacaagtgtttgcaaagattcttactcaaaaagtattttataaataatgcaatgtaagttctgaaaagtaagaaatctatactcttttctaaatactaatttagaattttaattaattaaatgagctcattctcattcagtccaatttagaaaatcttaaaatgtctttttctctacattttctcaagattgtcttataattgaggtataaaatttaatacagggtttgtttctacaactccccacagtgacatgaatagtgtcttattgctgatggtgtcttcagtaaggaaattcagtattggtggttttggctttcagtaatgctgcttgaactacaaatagacttctgagatgtgtgccagtaaaatttaatgtgtacttaaagcacacataggattctgtgttgaggacctctgttaagaaaatgtagctcaatgtagctcacatatagaaaccaaatgatatttcttacattagaaattgttttatttcaggactatgttaatagaacaaatattcagaccaaactggagctccaactttaagagcatagttttgcagattttaatatattaacacaatatgatattatgtagcctttaaaatttgtttttaaaaaccatgtaaatatgtgaaaaatggtggtgttatattaagtgaaaatgttgaggaaaataatgtactgtgaatgtgagtctataaaaatgcatatctgatggcaaaactatacttgtaataaattttccaattttattgcttgtttggcattatcataaaaacagtggaaaattagctgtatctcacttactaggaatcattagatggatcagcctgactagggcacaatgtgaggtcagcagctggttctccattctctgttgggagccactaataatcccactttgtttcctttgtctcacaatgaacagcagcagtgggggcgacaacttggacctcacccgtgtgcttctgcggaagtttagagatcaagatttgccctgtgcagatttaaacccacgccagtaagtgtcaggtgctctctgcaaaagtgaacactcccaactggtaatattgtagcctgggaggactgtttttcttcatgattggttatttcatgtcacaagtttatgttataaaaaatgaaaattagcctaatgactaggttattactgaatgggccttatgggtatcaccatataaaatgatccgaaataagcttcataattaccccctttctcccttcgtacatgcatgctttatattattgcaaaataaattaataattaacagcattcaatttgtttaataaaacccaaagctgaaaagaatgaagtaggaattaagtctgaattatgtcttagctattatttacttttagagaatccttgtacatataaaaaattaattatatatttttttaacttaaaagacttaaaggtcagtactgtacatcaatctggggtgaattactttgaaaatgatctttttggtatttaatcatggttattgtgatgatctttctatgaaacctggataggggaggcctttctttataaacacttatttccctcttattttgctcaattgttatatattgaagatctactacaagcaaagtgctgctgtaggaaccaaaattaatacggaatatggccctggtctcaaggaatttacagttctgggtagagcaaatgaggcaaatgataaaagccataatgatttattaagtgccagaagtgtatgtttttaagtagtaaatataaaaatctaacaataatacaatattggcaatttgttttctaatttgcgatgacatattttgcccattagtcatattggtaattagtgtgagactgaaaaactattaatgttctcagtaagaaagaattaatagataattatgctgcttcactctagtctttgcaaaacaaagtaatttatttaactaaaacttcaatggtaatgtttctatttttctcctctctgatggaatacacagggtgtaaaatatgtctacctttgaaaaattgaaatgtaacctagggccccatggggtccagccctggtccaagctgggatcaaagaagaaccagttagaaaaaaaaaaatcttttatctagtccttctccttccagaggaaaaaaacaaaaggtagaatcaataattaaaggacagcagaacgtattggacattttgtttggacacgtattttacttccagttccttttacatgggttgcagtagagccccaaactctcctcctctcctctctctgttccatgagctcctgccctccagcccagcctgcagatcagcctcatagcttttctcctctgtccgttcttcttctaccttcctggatttatgtttttgtgttctcccttttctttgtgaaatctacctaatctatccttaactcatttctatatttaatcatttctatctatttttgtggtcagcataacaaaagggtaggaggagaggtacatgaaaagatgctgtgaacacttgtattaataataatttatgtccatgttatacaaatagggcttgattcactaggacctcaaatcagagcaaaaagttttacttaaaacctgtagatttccttctgtaagtgtaaaatattgttgaatttgatgatatctacattttacctccttggaagacttgggcaatcacttgataattaactagaggaaacattttaaaataatacattagattctactgataggttgcttttctgttgagatactcagctctgagtgtcaactcaatggtgctatgttgaacttctgatttgtacctccctctcatacgaagacaatgaagagctctagaaaaatccactgttgtctaaatccgatctaaaatatgagttttctcacagtagtaggtgatgcataatttaaaatttaaaatgtgttaaagtagtcaacttttagtagctgacgggtagatatagatatttagctttattttacaaggcttatatctggtggcacttcagtgttgaattctcctactatttctaacacaaaatggtcactttcctcacccattcttgttaatggtttagtacagaacaaaagtcatagcaaatcttatatttctatcaaacttaaaacgccaagtggggagatggataaggtttatttttgtaattaaaaagaaagttattagatagcagtgatacaataaatcatctcagtactcaggaaaatctagaaggctcattattagccaaaaggtgggatcttcagagcctgtcatggctggtgacagattccctcttaggggcctgtaaagaggaaagttgaggccatggatcagcagtgtagagaatgtgcataccagggatcatgatagaggggtaatataggaccagtcttcctgaatccaaatctcagctccactcttactgactgtgtgacccacgcaacttgctgaacctctctctgcttttcttcatttgcatcagtgtgctctcagttctatagaaagaacagtcacctcaatggcagggtagttcttgtagagagcttttgttctcttaaggcaagttcctgcctcagaaagcaactctcaagacaggaggtccttagagcttctgcctctgtcttcgagatttaaaatgcaccttagcactttggggaggccgaggtgggcggatcacgaggtcaggagtttgagaccagcctggccaacatggtgaaaccccgtctctactaaagatacaaaaaattagctgggtaaggtggtgcgcacccataatcccagctactcgggaggctgaggcaggagaatcacttgagcccaggaggcggaggttgtagtgagccgagattgtgccattgcattccagcctgggcaacagggtgagactccatctcaaaaaaaaaaaaaatgcaccttaggtgattgaaaactccaggcagccctgtagtagagagaactatttcacccagtgtgtccaaacctgaaggaccaaatgaccctcctccagcagcctctctgcagctgtgtcctgtaggccactttagggaaatgctttgctaagtcaaagtgtatttttcgattcttaaactttaaaagaaaaattatgtagaaacttctgatttctcatagatcatcccctctgtctctcccttttatgaacattcacacagcttcttagtgaatctgtttgaacacaaaacttgttggaggctgagaagtgctcaaaaaactacctgtcatgggtcattatgtacctctcatggacacctagttttactctataaaagggagctaggagaagaataagggaggatttggaagagaaaaagaagactttttgaagtcatatattaaattataaacacttgttaaccatcatctaaggcatctgaaggaagaaaggcctgctgagtttcagaagtataaatggaattttttttaaaagtacatatcagatacagtactctgattaaatacgtaactctcttaggtgttatttccatgtaaactcttaagtttcaaactggagtccctataagctagtcagccaacaaagtgtggagaaatctttacgttatttttgttgtttcaaaaattacgtagacattgtactttgctaacctggttaatagaaatggcaagtttcttttcactgggcaaggctttcttcaattggtgttatcatactggctttctcattggagcagcacacactttgcatagagctgggatctcgacagctgcttcacctctctggaccccacctcttcttctgaaaagcagggctagtaaggatggtggtaaaaatatctagccggtgcttgtaattcggtaaatgctagttttcttcctccttttccaatttttgagtaattaagagtaattatcattactgaaacaaagtttgatttccaaatgctagaaaaaatattttaaagtatgggactcataaggaaatagaaatgatagggaaactgtggaatacaaatgtgtttttgaaccactgctacaaatggttttcataactgtttctgttgcacaatctttctgcaacagaaagtttaaccaaaaaggtttaaagaggaaatttaaaaattgtttttccttaagtgattattgaattactgtgtcatgccacaaaaaggaattgacgtcttgctgtttattaattgcttcttggtacctgtttatgagactgcaagcctcagtttccaccaggagccccagccgcaccgtgaaagtcctagggagccctgtgatacactcagtacagtaagaaaagtgagccccatgtaatataatggaaatgctggcgttgtaataaaacattgtcatcagattaacagctcaagctgtgaaaacaaatgtaagagctctgccttctcggcagtgggagatgattatcttgtgaactctgttctagtctgatgaaactctcttttatggaaatacaatggctttgtaaatctaaaagatcattccaattctctcctttgttttttaggaagaattcttcatgctggcgcacagatcccttttctcacccagaattccaggattcatgtggctgcctggtaggtttctgcagcatttttgatctttttaagtctaaaattcaagtgacaaaaatgagtttaccctatctataaaattttcatatttgtaactgtgtctttataactttttggtttcctggattagctgtttctgggaaaagttttgtcacataaagtgaatatttatagaacacagatgctgtatagattgacagtgcccctctccttcattgccttctgcctttggtctttaacattcccctggcattcattaagaaaatgactattcttcaagtaatgataaagaagctagaattgccctaaggaaggaaatttttctaaatttcaaggcagcatgacctcaaggttcttgccatatttttatttgggctagatattaacagctaagatgccccttagctctctgactatggttgattcttacaaaaacatgtggaagtaggtgtgccactattgaggtgagagacatcactgtctaatctgtgaaggagaataaattgaaatttatttggaaaactgattggaactcatctcaaagaaaatctcagactctaattaataaaaggcatagacctgctagccacaatcaataagcaagtatgatgacaggtctaatttataggaaaaagggaaaagaaaaaaaatattgaagttaattgagcatctgtaatggaaatggctatttggagaacgtgtttacagggccttcctagttagtggatgatgagatgcaattctccttaatagttgtcaacctaagggaagaaactgagacaaattaatataggtagagagtttatttgagccaaagttgagaacagctatgtgggacacacttccaagttatctttggaagtactctagagaacaaaaaagaagctcaagtgaaatggccttattgtctagggtgtcaaatgaagttatttgtctcatggccaaggaagtcaaggatgtggacacaccaagagtgagcttagagcagaaatgtaataagtgaaagaaagagagaaaactctctgctgcagagagggatctcaaaaaagcgttgtcattttgcagtgaagtgcaatagttttaataaaaaaagctagcagggaagggtgctccatttatatagggctcaaaaaaccggttaggactaggtgtgtcatttccataaggcacgaatccctggcagtccccaccccatctgtttagtgtacatgcaggtccttagcctaagttactccatattgcttatctcctcctactgtgcatgcattaggggcggaaccctttttattaatccattttcatgctgctgataaaggtgtacccaagactgggcaattaacagaagaaagaggtttattggacttacagctctacatggctggggaggcctcacaatcatggtggaaggtgaaaggcacttcttacatggcagcagcaagagagagaatgagaaccaagggaaatgggtttccccttatcaaaccatcatatctcatgggacttagtcactaccatgagaacaataagggggaaccacccccgtgttcagttatctcccattggggtccctcccacaacatgtgggagtacaaatcaagatgagatttgggtggagacatagagtcaaacaatattacccttcaaggtggatgtgcctggcccaggctagctcttcttatctatagtgttgcagccatgttccaagcaagctccccgtgcaagcttccttatgtgagtatgtcgaaaaaggaaaggaatgtgctcactggggcccactgtatgtcagtgaaacttgctgactacacaggaggcccctttctgtgagggaattcatctccccatctatgtttgcagcccgaactttcaggctgctctttgttagaaaataaatgccgctgaggaccttgccctaactatctgcctagccagtttcttccttccttctctctcataatttattaaagaaaaaagaatgaatcaggagagtgggtggttacaaaagtcgtttgtcagggattctcactggcattgttaggttactttatagctctggtggtggcactcagcctagggtccatatagcgagctgcttagaaatgattgcttagcccaagggggatggggtggagtgtgactgctatctcactccagtgcctctctgggcctgattatttaaagggagctcacattcctcagataaaaagtttttttgtttgtcttttttctagagattttagaagccttgcttttggaggaactagtctgctttcttctcttagacgaaagatacacatgtaagcgggaatagtgacacagtacgcttagtgagcactcagagtgttggttgatatgggagaggttttggaactctccatgtttccctcttggccccagctgtcaataaactcagctacatttggtgatcctttgcagtgatcagttatctttttttttaaatacataattattgttttttttcccctggtcttgtttttccatttattcactttaggggcaaagggcaaatttccctttcaccctctgaagcttcactgaaaatcagttgacaaaaggcaggttaactggggaaataccatacaaatgtgtgaatttgcatgggaggatcacatcacagagtaattaccccaaacccccaaagaggtgcagaaatttctatacccttttcataggggaaggaggagatgggaaatgtggataattcttttagggacaggaaatgattgttatagagaaagaatgggccagggagagagaaattaggttctctctaattagatgattagatgattagaaattagatgattctcctggaatttgagtgagcccgaaagtcaggcattatcttgtgaaaaagtccatccaagcatggttgcattcttcacacttcttttctgaaatagataatgagatttcagggaggggattgaggacttatgtgtttcctttggtaaggagttttttggtcagatatggaaattccaaagagaattggaatggaggaggaacaagacaaggtttcagggaccttgattctgaggcttatttctgaggcctttcaattgataaaaatgcccagcatgcacaaatgccatattttgggggattgttttctatgcctcagcactcatgagatctctgattttttacaccacgctcttattctctagccttgatttgatcattctattatagtagtggcttttagtaccaccagctacctaaggcctattgggattagagtgggtaaatatcagaatgattggtgtttatgttcctaaattcacttcaactcacataaactatgagatttcagtaatatgtaagaaaaaaggttttatctgaaaaagttccatagtcaaatacgttttgcaaatgctggataaagcagtattaagcaggtatctttgccacagctcttctaagaagctatttggtgataatgaaattgtccttgaattgacagtggagtagatgcagcattttctgcaaatttgactgcaagagtccttcccttttgtggcagcagtgtgtttcgggatgcactttgagaaatgttggaccacacgttagaaatcagagaacctcaggagacagggagttgaggtggaattaatgaaagtcctaagcaatgggtgtggctactctttggggttgtctcaaaggagacgtacacaaagctgtgtggaaggaaggcctatagacccaaggccagttctctggtctttagtgttcatgttgagccaagttgactgtgttttgttagaaggaaaaatatttctcttcccttaaatacatgtgtgctatccagcagccctgggtctgcaagagcatgtcaatttaatttttttttttttttttttttttttgagacagagtctcgctctgtcacccaggctagagggcagtggcgtgatctcgactcactgccacctccgccttctgggttcaagtgattcttctgcctcagcctcctgagtagctgggattacaggcatgcgccactgtgcccggctaatttttgtatttttagtagagatggggtttcaccatcttggccaggctggtctcgaactcctgaccttgtcatccacctgcctcggcctcccaaagtgctggggttgcaggtgtgagccaccacgcccaacctgtttcctcatgttttatcaaatatgctgtggctgtctccaaacctacaaaaaggttccatggttagtccttctgaggatgaaaacatgatttggaagcgacaccgttagaaaaggcttaaaggggaacaggaattgagctaactctaaagaacaaacagggatttttagggtctgagctccagtggataacaacactatgacccaaaacatgtcatcgggactgagtgtggctttatacagaataggtggagggcatatttgtttcttgtcgctgagataataaattatcacacagttggtggcttaagaaaacatgagtttattctcacacagttctggaggctggaagtctgaagtcagtgtgactggagtgaaattaaggtgtctgaagactcttgaggacaatctgtccttttcctcctccagcttctcttgtttctggccttccttggcctctggtgacattacacacatctctatctccattgtcacagtgcctcctccccttctttctctgtctagtcctcctctgcctccctctcacagtggcacaggttgtaaccagcaaaagggcctggctgctcgctgcttgtagaaagaggccaaaataataacgagctgattaaaagtgagcaagacttttttatatgtgccagcaaggggaagagcagaaagcaattccgctgtaatttgtggagggaacacagggttttttaaagaaagggtttggaatgcagaagaggcaggggtggtaggttgggggttggggagcggggagctaggaggtcccaggaggggttacttactccaatggttcatcttgaattattgtttcatttggtgaagaggctgaccccatcgtggatcctgccaggttataaactaatcacaatcttgtagttagtcttcagccgggaatgggttctggccttgaagtaatcttttgttggggacagattttcagaggtgtctagtcctctgaaacttctaaggaaatatatgaccaggtaagtgagcatggcatgtgcttaacaagcatctaggtaaataaatatgcataaggcatgggggcatgaagtgggaaaggaaagagaaagaaaacatttcgaggctataagtttatctcagagctacatcttgaaactcggaggggaaagaggaaaagggaaaggataaaacattttaaaatgttgtttgaggctaaactgctaagcagctcagttacaaggtgagtgcatgagggtgcactgtcacaatccaggataatcttctggactcaagatctgtaacttaataacatcgtcaagatacaaagtagcatttaaagagtccagagatgagggcctgatattttggtgggggggcggtcaatattcagtttaatacagagggtgtatttggggacacctacacggataatggttagaatgagaccaaggatattttctcatgatcattaaaaagtcaggaaacaacaggtgctggagaggatgtggagaaataggaacacttttacactgttggtgggactgtaaactagttcaaccattgtggaagtcagtatggcgattcctcagggatctagaactagaaataccatttgagccagccatcccattactaggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaataatgagttcatgtcttttgtagggacatggatgaaactggaaatcatcattctcagcaaactatcgcaaggacaaaaaaccaaacactgcatgttctcactcataggtgggaattgaacaatgagaacacatggacacaggaaggggaacatcacactccggggactgttgtggggtggggggaggggggagggatagcattaggagatatacttaatgctaaatgacgagttaatgggtgcagtacaccaacatggcacatgtatacatatgtaacaaacctgcacattgtgcacatgtaccctaaaacttaaagtataataataataaaaaaaagaatgagaccaaggatattttctagtagacctgaattcttgataataattggaattttttttagcaagaaaatcatctaatggaaaacaccattttagaaggatgtatcttgataagtatggggggtggtgaagtgaattggagagaggaaagctggaggtagggaaactttggaggttgttatgttcatcaaggttggctgatttatttatttattttaattgagaagcagaagttatatatatttgtggttacagcatatcatatatcatgatatatatataatacataaaatgatatgatatatatacatatatcattatatatacatatataatatttcatttatatatagtatttcatttttatatatatcatatatatcattttatatatatatatatataatcacacacacccattatggaaaggctaaatccagctttttaatatatgcattacctcatgtacttattgtaggggcacaggaaaacttgcccttcatcctctgtaagtttgctaaaaaatcaactctaaaagcagattaattggagaaaaggcatatgaattcttttaacatgtacagggggagaattacagagtgattatctatcccccaatgaagttcagaagtttatatatcatctcaagtttaccaaaagaatagggctttggatcctggcaaatcaggttatggcgggagaagacgcattctgtactgggacaataaaagattgcaatagagaataaatggatcttggaacagacactctctgtttaggtatggttacattcttggtcttacagggaggagaagaaataaaacattctccttggtgagtctagattttagttaggtaaagaatttcaacttcatcctgtgctttgggagagatggtgggtaggagggaggtcagagagaccttgaagcttctttagctcagcatgtgaaagcaccacattttggggtattgttttctgagccccaacgttactatttgtgtgcatgtgtttgtgtgtgttgaggatacttaaaatctactctttttttttttttttttgagatgtagtctcgctctgtcgcccaggctggagtgcagtggcgcgatcttggctcactgcaagctccgcctcctgggttcacgccattctcctgcctcagcctcccaagtagctgggactacaggtggccgccactacgcccggctaatttttttttgtatttttagtagtgacggggtttcaccgtgttagccaggatggtctcgatctcctgacctcgtgatctgcccgcctcagcctcccaaagttaaaatctactcttttagcaattttcctttttcctttttttgagacagagtctcgctctgtggcccaggctggagtgcagtggtgccatcttggctcactgcaacctccgcctcccaggttcaagcaattcttctgcctcagcctcccgagtagctgggaccacaggattgtgctaccacgccctgctaatttttgcatttttattagagatggggtttcatcatgttgcctaggctggtctcaaactcctgacctcaagcgatccacccacctccgcctcccaatgtgctgggattacaggtgtgagcccctcgactggctcttttagcaattttcaaggtacaatacattgtcactaattgtagtcattatgttgtacaatagatctcttgtacttttgcctcctgtttagctgaaattttgtatccattgaccaacatcctctctgccaatcaccattttactctctgttcctatgagtttgacttttttagattccacaaataagtgagagtcttgctgaattattatgtacaacaattattattctttttagtatctttcctcaagcctttctttcaagaccctgaaagtagtatcttaaatgcatatcgcccttcttactttgctgtagttctttcatgtgtatctgaacctaacagcaaatccatgcatttaggtaagcctgttttcattttcattttgcaaataagcagacaagcttccaaagctgtaatgaatgtgaaactggcccaaatgtctcttagaagtaatatttatggattttcgaataaacatagaaatggaccctccctggtcttaaaagttgaaacttacatttctctcacctgagtttcttcctcaagaaactgatcctcaggcaagggactgaaatacgttagatctctgagttcagaaaatgagactccagacgtcttatccatcatgattgcttccttacccctccttctttcctgttttcccattttcccctccatataacccccaccagttttagatggttgaggagatggatttgagactttctctttcattctcctcagctgcagaactcagctaaaagcttcctccctggcaacactcattgtttcagtgattggctttctgtgcagcaagaccaaacccctggcattttgataacaaaagactcagagacagagtcgtttcctattttaatatatcatcttttctgaaagtgtttgagaaatggaaacaaagcacattaactctaaagccggtctgtggcagggcagagcacatcattgcgcagcctccagtggcctgggttttgcgttgtgttgatcacctcctcctaccttgttaggtgattattccatgatgcagagctggtgttggcatgctggtgagtcgctggagaaaagctgtttgatttctactttagacccttatgaaagagacacacgcctttgaattatcctgcttatcttcctcccactagttgtttctgactctctttcaggttcgtcaaatgcaagatcaccccagtgaaaacattttttttctttttagtttttataaatctgcccaaacttacatacagaaaaggatttgaagttctcagatataattgactgcataagtcacagtggtattctggcataattctcaaatacatgtgactgaaagagattttagaaattagaacatataaagggctgcagataatttattaaaaattgaaagctagagaacaatcacatgtagtttcaagtaatgtcagtgaaccagtttgtgaattataaaaaagtttgtttttatctttttgaaaacaatttcagaagtgtccaaatagaagtgctagtgctccctacctgaccaaccacctgggccacacactgttgaatctctcaggcttcaatatggaggagtacttgctggcaccatctgaaaaaccaaggtgtgttcaatactcttgttgggtctttacttgtttggattactatggaaaacttattgttttaaatgctaatgttcttaaaaagtcaaaaatctaagactgaccttggtgctcataaaaattccacagtgtgtgatgttccccttcctgtgtccatgtttttacattgaaagtagacaaatagttttgtcatctgtttctcatccatttctaatatttaaatataataaagtctaattgaatacaaaaacaaacaaaaaaaattccacatagatgccatggaccttaataagattccttactgctgactttcactcttttaagtgctgggggaaatcctatcaattgagatttgtcagtggcagaagcacgagagccagaagctgttttactgctttaggaaataagagcagataagtttacagcatgcaagctccacctcccaggttcaagagattctcgtgcctcagcctcccgagtagctgggtctacaggcacctgccaccacacctggctaatttttttgtatttttagtagagatgggatttcaccatattggtcaggctggtcttgaactcctgacctcaggtgatcctcccgcctcaggctcccaaagtgctaggattacaggcatgagccgatagctttttgaaggtgggaacttgtgtgcccagaacttagaatattatctggcacatcaaagatgttcaaccagtatctgttgaatgaatgagtgtattcagttgagccagttgggaatgtgtacttattcctttgcctgaatttttgctgagagtagaacactgtgatagaagagaagactattcttcagtctccttttatctagtgagtggaagacaaaatttatttagataatagttaacattatatttttttaaatgttaaccctttttttgaagtttaatagatacaagatactgtgcaactcatggagatattaaaaaaagatataattcccacccaggaaaaattcacagagctacataaagataaaccagcaaatagacaataaaacccagtgtggtaattgataacaatggatggaaatacagggtattgtgggaactcaaaagacaaggaacatctaacccacttgaaattgtctggaatgctttcctaaaccagacaagatttgagtgaaagattaaagaaatagagtagggaagacaaaccagagtggctcaaaagattatgaccactattaagaaattttttttttttttgaaatggagtcttgctctgttgcctaggctggagtgcagtggcacgatgtccactgtaacctccgcctcccaggttcaagcgattctcttgcctcagcctcctgagtagctgggattacaggtgcctgccaccatgcccagctaatttttttttttgtatttttacaaaatacagaaaaagacagggtttcaccatgttggccaggctggtctcaaactcctgacctcaggtggtccatctgcctcggcctcccaacgtgctgggattacaggtgtgagccaccacacctagcccaagaaattctgaataatggatttgtagagggaatgaccattaattaaaataataacagtgctgatgatcaagccctacctgttacatggcatgtatttcctaacaagacagtaaggtgtgacaagtacactttctaatgtggccagccttatccacaccttctcaattatcagtgccttccgttttgcctggcttgggagccaggaaacttgcatcagcacagcacctgtctgcctgtgtgttcatgtcacagaccacagatgctcagttggctactgtcctaagactgctgtacctggtggggttagtaatgaataccctctgattagaagtcctggtgctctgtggttgaagcactaacacaatgttcattgttaacaggcttggaggttggtcttttggattaaaaatccccagtgaagctggaggtgcaaatggaaacatatcaaaacccccaactctggcaaaggtaatcatatttttttatttttttcctgttttagaaagtatttaggaaaactcaacattcaaatataattttgagcacagggttcagaaggaccagattaaatccaatcatttgttactaagcatcaaggaaaattatatgtaaacattgtcttgaaaaaaaatggcttgtttttctttagaaatcgaggaaataggtttttgctttttgttaagacaggacttcacctagtaaatataaagtggaggaaaaaatctattttcaaagatacccacagttgtcataattggaaatatcactagtttctttgctggccaaggagtacttccattcatgaatgtaaatgccttatcttccagaaggctggatagataggcctggagatgacacaaagaaagcagcagttacacagagctactcttaggagtcctggattttcaagccctgccaggactatacctgtgaattaggaatggtccccttagaattaaagagactaggtgggagattcttcagctttgagagaatgaggactgggatagaggaaagatgccttgatccatcagtaggaatagagaagtggtgaacccaacagtgagttgttatttaaggaaaaaagtcaacactaccttaaaatggggaaagcagaaagattcaaagcattcagtctccatgactggagaaatagtattgtgtttgattgagagagaaatcagaaaagggtagattgtgggaggaagttaagtccactgcgggagagtgagtgtgagttcttattaggatatcagtatagacatttcattctgtagtgtgtggatgttgtgtctactcatgagccaattgtggagctatgagaacaagaacaatctccatgagcccaggaaggcactctctctcttctgtagtggggacttgcatggttcatgtgaacctgaaggagcttattgggataaagacatgcacatgttggaggtttattcagtgaaataaaagttcttacaggtgcttcacaatgtcatccctgatgagacagtcatacttcacaatgtaatccctaaacaaaattttaacagtcatgtattacgatgtaatctgggaaaaatttccagtcatagtgtggacgattcaggaatctctccaacagctgaggtttgttcaaatctcttttccttctaaagacaacacacattcatgaagatttaaagcttgatatgaaaatatcattattaataacttgatagaaaaataaaatgtatttgctgacatatattggaatacattatgtggccattatgaaaatatacctaattagtagaaggaatctgttcatttcctctacaaatattccgactttttagtctatcccaatctaaacccttcttacgtattcataggagatggttgtgtctttgctttgaagtgtctgaggcacggacctcttgttcagtgatgagtggctggggatttgtgtgttctcctcacatctctaactttttgtctttgtttagatgagtcttctgtactgacatgtttgagtggtgattgctgaagtttttaatgttatttacgtgtccttcaccaggcacaagcatgcaggtgaattatacttgaccctttggggactgagctcctctccagcaagccaaggaactcaacattgttgtggggtgtaaagggcaatctattatttgaaataccagaactgctggcggctgatactgcttcaaatgattgcatttatctttctgtaatgaccggctttttctttcagcccttaggctacattcatcgacatagatgatatgatttcatagtccttctgaaggaaaacatgaaaaatttgcatatgaataggcttaatgtatggttcaatatcttgtagaatgtctcttgtgtgacctttatgagttctatcattcacatcttgagtgtttagcttgtttaatcaaaacactctttagaacttacacacttcagttaaagaagccaaacacattttcactttcgtttttttcatagttctgttctcccatggaattttatatatttgaatatccactgagagttttttttttcttatagctgcttagttactttttggaggggctgttattcctgagatgaaaggtctgttttgaggtgtcatagtatgttcctaaaagaagattaatttcctatttcattattggactttatcacttcgtgacttatggactggtagggaaggaaatcccacagcttatttccagaacacagcctagttttagaaaaccattcttgggagaaaaagaaaaagaaaaagaaagaaataaaagctttttctttgatctctgttaagtcctgaatggtaactttaagatcatcacaaagtatgcatttattacttaaagaatctataaaacctttctcaagtaaaggccagtttataaaggaaccgatcaggagttccagaacattttaaaatctgttccttggaactctgcaagtcaatcatttattgccaaaatgatgctatgtagcaaacaactgcaaaccgttagtagcatcaagagtaaacatgcatttcgctcatgagtctgtgggattgtgctgctgtgggctgtgcataacagatggtgccaggccccactatctgtggggaatttgggatgctctttatccaggccctggttctacatccttggaatgttccccagctcatcatctgcaatgacccttaactctactctgccaggtgcttccccttccattgccctccatagctatgtgtgaagatactttaaaatatgccttttgagtagctctcagcctgcttcctgcctgtggacagctgggttcttagagctatttacattttacatgtattccagcctggggtaccttcttgatatagcttcctataaagcaccctaggctttctagttttctaactgagatccacaagctactctcacgatcttgttgagatatgctgctctctctaaaattaattagtggcatttggggaatgccagaatactagaggacaacaccctttaggttcctaaaagccctgtgtctccctgagagagtctcttagcagcatcattctttgaagatctcaacaaagttcttacaattgcacccttgacttgatctttcttctgaggccatgtctttcaacattctctcaagagagctccgtacccaggtcaagatgtttattgggcaccatttccatctttgaagttaatacaggtgacattacccactgttttcacactgtaatatgcgtcacccttttttcaattatttatagcagtttgttttttattatttttccccagtattcctaaatactttatcatgtatttccaggcttctcaattgtctctttgtcccccaacttgctagtatcaaaagcaacgccaactattttcggtttttggtacagtaacaccccattccagtgtaaatcactatattggtactctattgccacaataatgctctataacaacaatttcaaagctcagtggcctccacaatggatgttcatttagctcacgggtctgtgaggttttgctaatgcagactgggctgggctgatcttggccaggaatgaacatgtgtgtggtattggcttcagctgggatgacagtggaggtctcagctccactgttgcatctgatgatagcagaggcataagggagacttcaggaacatacatgtgcctctcaattgtgccacattctattggccatagcaagtcacatggccaagcacagcatcagaatgggagggcatgaaagtcatatagcaaagcatgtggatacagggatggtgaagaactagggcccttaatacaatcatgaacagaagttttggcccggtgcagcggctcatgcctgtaatcccagcactttgggagtccaaagtgggcggatcacctgaggtcaggagttcgagaccagcctgaccaacatggagataccccatctctactaaaaatacaaaattagccgggcgtggtggcacatgcctgtaatgccagctactcaggaggctaaggcaagagaattgcttgaactcgggaggcagatgttgcagtgagctgagatcatgccattgcattccagcctgggcaacgagcaaaactgtgtctcaaaaaaaaaacaaaacaaaacaaaacaaaaaaaacaaacaaacacaaacagaagtctcagaatctacaaagggtgaaactagggaggctgagcaggcagcctcctgtctttccagctccattcagccaaagaagctctgtttttgtttctgtactgtagtgtggtgtcatttttaagttttttttttaatcactctacttttaaaacaaaaattaaaataataaaacaaatcaaaacaaaatttaaaaaaccttaattcagggcagggactatccttgtgtcttctattttttccctaaatttgaacagttaagggaatcaagacttgggggagaaggaggtcacagaccaggctagtgggaggttccactttccataggcagtgggcttttctaccagattagcctgtcccttaacttcaacagaatcctgagtttctatcatttccagaaatctggctagtgcctgtgtaggtgtctgtgtgtgagggggcagggtggcatgggggagaccccaaagggtgacagtacagagttgtgtgggtggatgacatggacacacctctgatatatgacataaactccttcagttcacttttgacttttccatcaaaggaacttggaatttaccctactttggagaattgtgtctatgttgctgtagtttttttgtttgtttgttttggtcacaaaatcccactctgtttagacatagctttgaacactcacagttctgtagttagtgggtctcaagctgcacttcttctccttggggtttaaaaaaatgattggcaaggatttctctgtgaacttaagaaaatattttaaaatgagtggtgtgaaagatgagatctgcattctgaattgcctgaagaggtaggctatttgagaaggaattggggaacattgtcttgtgtagtagggttttgttttttttttttctctttttggttttttaactatatgatcaatattttattacttagctgtttccacaaacacaatagctgccacacaagtctctggttaaaaaataattagttatagcatgaaggggtggaaagaaaagagattggaagccctcaagttggaagggatttgagatctggtccaaagtttgcataaactacgataacttgaataggttcccccaagccttaacttgctgtgaggcagcggtaattctaccaagcggattatctgtcacaaaaggcagcctcttctagagaaatgagctgttcagtcaattgaattaagaccaaaatgcatcagttggagtcatcatacttcttgaagacactcacttgcttttcaaattaataatatattttcatttttattaaaatattgatactttgaaatatagatactgatggtttgattagtgttttttatgatgcttctcattccagctttaataacattgtctttctcttattttcacctttctcttgacaggcatgctactttattctccatgctcagcaaatgttcagttcagtttattttgagaaataatgttccatgttcagttattaatttgaaagtaatcattttttttctgataatcttccacacatttaatttgcaggtcaaatttcagtagcttactaactgagaaagaaaaaaaaatgatagggtttggttcctttattcttataagaaaataattatagagcaacattcacatttgttctggggaaaattaatctatttttagctgtaaattatatgctggagataaatataaaattagcagactagaattgactgctcactgtcagccatgcaggaacattactttgaatcctgcactcaggtgccttggaagttaattgacacatacgttccttaaatcccagaatagttgacaaacagacttacgagctaatttcgtgagagccattaaattatctttctttttttaggtgtggtataatcagaagggttttcattccctaccttcctacttaaatcatctaaacaaccttattttgtggcagcacctaccccctactgtggactggagacaatacggtaatgttatttttcatgcattgtaattcactactttcaaaagacaatgtttttaaaagtgaaagaaacagaaaagtttctgaatagaaatgtgaggggcaatgagaaggtttctacttggcaaccaatccgtgtctaaacacaataccaagttgtaggctgtctttccctttgtgtgtcattaaatgtctttattttcttgaacctgtaacctcatctgtaggatgaggggaacaaaatgtgactggagagttctctcctaaaattattttattctgtgacttaatatcttacagaagcaagaaaaattttaccttttaaagacaatattatatggaatactgtaatagagaatacagactgtccctcctccttatcactgggaagatgaacatcacattttgatttatgctgagccctcaattcatcagttatttatgttgatcattgattcattatctatgctttcttattttggtaaatggcacaggtccatttctggtatccagagttaacttactggtttaagtgaatatttatttatttcacttaggtgggataaattataatttgttaatttaatttagcttcttttttaaagaaaggaaagaaacaagaagtataagcaacaggccatgtccaccacaatttattcacaaaatgtatttgttgaaacattaattcacatagacatcaacactaaacaatttttctaatatgctctcactttatttcaatcatactttatttttccatatttatttttccttctacaccagttttttaacaaagtaaatttaattattttgtggcattgtaattattttggaatgctaataggtaatgtaaaagttaaaaatgtacgtgactaagagaagtacaaaaatagtacaatagtcatacagagtagggacagcagaataacatttctaacatatttgaagtgtatcaagaacttcattagatatttaacatccatggtcttatctgatttttatgtcaattttgtaagatagacaatatttgcctactttactgattagaaaactgattttcagaaaacatcgcctatcagctgtggctctgagcaaggtaataatggggccatgactggattctaggtctagctgataacaaactcttgcttttctactacatcaaactgagatgtcattctggtgggcatgaatacagcatggttcacagaggggaagtcattaacactggatcttgaacaatgagcagaagtttgactgaggtcagaaagccattctaggtcttagcaatgcaataacaattatagtgtatgttcagcttatatggaacagtccagtttcacctcatcataaagctgaatgtagagggataattgttgatctctttggaaagattgtttaagatcaaatgctgcttggctttgactgacatgatgaagagtatggactttagtaagcaatggacaggctttaccaatatgtgagaataagaatgacataatctatgtaatatgttaggaagaatgatctggaagccactgattaaagggagaagactggttgtaatttaatgacctattggaaggatactgctcacaattttgaggttaaggccaggatgaatccagaggaaaaaaatgataaatttcagacagatgggagaaaagattgaggcactagggatgggaataaaaaagattttaagaaactaaaatataaacctgagcattttagagttcagtactgatgacattataagaaatggcagggagaagagatgttttcaaggaaggggcgaggtgatttgtgcaggattagagatgctagtttggttcacatacatagatgaaaatgtgcgtaggattcagaaaactggagagaaaagtttggtagagcagtcataggtaacctaagttctaacattaataacaaatgatagataaaggtgttggtaaagtgagatcctgcacgggtcagacacaggctcagaacagaagaaggctatgggtagaacagagggaagaggacaaaggttctgtagcccttgaggtaagaagatcttgcacagaggccagtggagggcagaatttcacatggatgggcaggaaaaatgaaatatttcagggtcatccagaagaagtagaatgcagacgttttgctggtgacttccagagggctagttcaatggtgtttcagaaatggaaaattaaagtagaaggaattaagcagagagaggttgttttaaaaacttgagactaaacagataaattctaatttgacttgttgatgcatcatcatgggaaaggaaggtttgtgcaataaattgggaatatacaatacatagcaccacaggaaggtgtgttggcagttattatcaaaatattgataaagaactcccacgagcagggttctgatgaaaatatttcatcacatcccttgatgcttgcttgttcctgtgggaaatggacagagctagaactattagcttaatacttagagtgaaacaaaccttgccccaatgtggaacttcagtaaatcccatgaaaacagaagctgtgtcttgctccctgttcgtctcagcagtcgcacagcaccaggctcaggggacattcaggctataacaagtgaatgaacggatcattatactacacggacaatatatcacacttctcatgacaatggtttttgatgaggtttcagcagatgtacacattctaatattagagatttctgaaccctgatgcaggccgcttgataagaagctattttcttagaacccaggctggccctttctctctaggagacagctagctgctcctgacctatcttctcagcctcatgtctcgcttatggcccctcactttcccctccgtgtagctggcctttgcatcactgccctgccatccctgtgagcctggtagctgcattgcctctgctgagactgcctgtcttctcctgcatcaccttaagcatttctgcttaactttctaggcccatctcagacatcacctctgttggaatactcaccacccctgcaggatgagttagtggcttctctttcttctcccacagttatttgcttatgaaattcatccatatatttatttctatcaagcattcatataatgacagatatttcccagacactgtgttaggtcattgctgtattttaaatgtgtctcccaaaagtctgtgtgttggaaacttggtccgcagtgtaacagtgttgggaggaggaacctttgagaggtgcttgggtcatgaggcctcctctgtcatgaatgaattaatgtcagtgtctcaggagtgggctacttattgctgttgccatgcccttggacttcccagactccaaacactgtaagaaataacttttttcctttataaattacccagtctcatagctgggcatggtggctcattcctgtaaccccagaactttgggaggctgaggcaggtgtatcacctgaactcaggagttcgagaccagcctggccaacatggtgaaaccctgtctgtactaaaaataaaaaaattagctgggcgtgttggtgggcacctgtaatcccagctacttgggaggctgaggcaggagaattgcttgaacccgggaggcagaggttgcagtgagctaatatcactgcactccagcctgagtgacagtctcaataaataaataaataaataacccagtctcaggtattctattatagcaacagaaaacagactaagacagtcattagagcagttgatacttcacattatcattatttgtttacattcctttgttaataaaagtgtaaacacttcatggaaggtgtttatactactgatgtttgtgttttctaaagtctttattcataggtattcaataaataggtcatttaagtgaatttgcttttgcactatattttagggttactatagtacattccattatgataattacattctaaaataaagataaatatgcagcaaaatatgtacttgcttctttcgttattaggaccttttaagttggcataattttgttaaattaaaatattaaataaagatataaaataatgaacctaagaggaaatttcttttaataagattaacagaataagtgaaaacagaagattaaatagaagtgcttaagtagataggaaggtatcttcctctgatagagtaaaaatgaaaagggataaagtattattttattttgtgttattgggggtggttgtgggtggtgatgatagcagttgtaaaggttaaacttcttcaactacttattgaaatttcatccaaaccttggcatgccagtaatgaaatgccaccatgtgggaggaattaacctcagcaatgtcatgaacaagccagatccatggtcattaaactgtctgtacattggaatcacttaagcatttaaaaaatattgatttatgttgcttatccaaagattctgatttggttgatttggagtaagtctttaacagcaggcatttttaatgtttttgggtgattctaatggtaaccaagtttgagaaccactgggttaaactgataaacttcccagctgattcatattctgaccactgaagcaggaaaacagacagaagtgtaagttaggagtcagtttagagatatccacactcaccttctcactgctaggaaggaacctgatggatacctggctactgggtgtcaggggaggactgttctgtattagaacaagaaagagctcttgactttcttttctccccatttgtatatctcttttggaatcccctggagggccacaactcattagtatgctgcaaaccccagggaggaaggagaagggtggtgcatgttgcatgctaggatgatgggacagagatgaaatgaacctgggagcagtggatgacatgcatggtagattttcctgctttgcttttgatgaaatgagaaacctgctaaaatctccaaatcacaatgagagagtatgagcatgagaacaggggaaaatctctgatctgtaatagagctactgaatgaacagcattggctgttggaattcggctggcatccataaccttcaacatgcccttgagagctttgggtatatttgagatatttgagagagaagatctggtggtacccgagtgaaggtaaaggggcaccctggtaagggaggattctgagcaatgcaaagcaccagtactagcttgcccttgctggaatcagggagtaagaaacaaaaggacagcaaagccagttatcaaacccagtatggaacaaggactgatcccccaaccacagagaggaggacattgcataccttgagagggtgttttcatggggagcatctcatgatgtgtttatatctgcataaatagaggaaaatgtgtgaaccctatgaaagagaggataaaagataagaagaaaatgccaggctgagctgcagtgtgttacaaaaacggagctagctaagatgaagatagaaatatgaattttcattggatgcagtgaataacattattgattgattacaaacctctctccttcacttagaattattgacttaaagaacaaacatgcagtattctctaagaacacacagggaaaaggtgacacagtaaaactgatcagaggggaaaagctagaggaatcgggtatagaaaaaaagcagatgaataagaaagtaagaaggaatgatgtaagaagaaaatgaatcgaacacaaaacaaaacaacaaaataattctgtaccaatagattggaagagtttgtcatgattctatcaaaatttatgaattaggtattatggcagtagcaatgattgatgcacaaatttgatgaattttctaaagttcaaggataaagaaaaaagtttttacaaagctatgagtcaaagcacattagtttcaaaggaataaaaataagactggcctctgacattttttataatttctcttgagacttcatctttgacccagggattatttcaaaacatgttgtttaaattctaagtttttgagattttcctgtggtctttctgttactgatttctggtttggttcatcacggtcagtgaccatactctgcattatttcaattattttaaattggttgaagttcattttatggtcaggatattgtttatcttgaagcttccatgggtgattaaaaaaaagtattctactcttgttgttagaaatgtacattatatgtcaattagatcctgttggttgattgtgtggttttgttcttccatatcttcactgatcattgaagattactgaaccttcactgaagatcatcactgacacatttcgtttgctgagaggcgagtagtaaagtctccaaattgtggctttgtttcttttttcagtttcatcagttttttcttcatgtattttgaagctctgaggtacacgtcaaatgtgtgtacacatttggcatggtcacatatttctggtggattgagccttttatcatttgggatgattatattttcctggtagattaatcctttgcatatatgtagtgttcctctttgtcactagtaaatgtagttgctgtgaaatctattttatctgatctcaacatagtcactccttctctttttcttttgattaatgtttacataatatatctttcccgttattttatttccaacctatctcattgtgtaaagtgagttttgtgtagagtgtatattgttaggtcatattttttaagctgcactgcctatctctgccttttaattggtgtttgggaaccattgcatttaaggtaattactaatatatttgggtgtaagtctgacattatcatttgttttatgtttcctctgtttctcttttcttgctttccatgagttacttgagcattttttttgattctattatgatttatttatagtatttttaagtatatacattcatttagttttcttagtggttcttctaggtgttataatacatatatatgacttatcacagtctactgatattgttatttactaccttgggtgaagtgtagaaagcttacttcaatttacttttaccctgtttacctttaaaatattattgtcttaagtgtttcctatacacaccacatcagatggtgttctaattcttagttaagtcaccaaatatgacttaggaaactcatgagatgaacaatagtctattatatttacttctatttttaacgtatcttgatgttcatctttccttttgtaagttctaagccttttcctgttatgatttcctttgtgcttatgtaacttctttttgctattctttaagagtaggtttgctaatgaaaaatttgcttatttttttcaactgatacgatctttatttcaccttgattcttgaaagatattttcactgaatatagaattcatggttgacaattaaagaaaagctcagcacttgaaaaatgtgctacttccttttggcttccatggtttcaaattagaaatccattactattctagttggtattttcttccttctctctttgtgacggctttaaagaattttttttgttgacttattagtttctagaaatttaattatgatgtatcttggtgtggctttctttggttttatcctatttgggatttatttagctcttggatttttaggtttatggtttttttttgccaaacttgggaagttttcagctgttatgtctttgaacactttttcagccccactctctctttcccttttctctaagatcaggtaataagattattagctcttgtattgttttcccagaggtctctttcctgagtctcattttttaaaaagtttatttctctatgttatttagattggataagttttatttttttcatctcgagtccatgcagtctcttcttttttagctgcactcaactgtggagcatgtccagtgggttttaatttctgtcattgtatattttagttctagaattttcattcattttttaatcatttatattttctaatgagattttaatttgtttttcatatttaaggaaaattcaaaattactttttgaagcatctttatgatacatattgtcagataatttcaacattcagttcattttgacattaccattttttattgcctttttcaactggtaatattctggctcttgttgtgaaggattattttcagttgtatcctaggcattttggaaactgtaatatgtgactctggattccttttcctagcaggcaagccctctgttgaggaatcatatgagagccacctagatgtatatgttttgattccctgtgggcctgatgacaccaccctggctaggcaaaggtagagaactgacttacactgcttttgtgcagatgagtgggaccagatcgcccaccagcctcactgacacattcatggcaaatgaggcactgactcatgctgtctcattgtctctaagtgagtgggggagtagagtctgctccccattgggccctgatgacgctggggacaggtagtgaagtaccagctggctcactttgaaagtattctttagtctcatcgaagccagatgggaatggatgcttggcatccctctgtgccctgctgccactggggtgggggcagtggtggaaccagggtactgagtagccgtattctgcacttctgggttcagtctcattgctgtcaggtagatatggaggctcagctctttgttggtccctcatgacatgagaagtagagtggcggctagccctgtctcactctgctttgtgaagtctcattgctaccaggtggggatggagtctcaacttgcctcaggaccccagtgagaaaaccactgtgccccttgtctctgtcaggtggggagtggaagattcactacccaatgggccctgctgaaacctgagatggtggggacagttttgctggtggtgtttgcctagagtaaggcagatattgctaaaaagtagttcttttgttagaccactcttttccgggtccttgggttttttatttttgggagcctttcttatttgtacttgttgagtttcaatttggagactttggcaatgccttgttcaggatatatgtgaggtgataaggaagccagaatatttactgttgtattgttgaagtcttatagtctcagggcaccatcatcttgtttgcaccccagaatcttcctatttctgtttgttgtgttatgtccagcagttttttattgtaaaaatgaggacttggcagaactggggctgctccatctaggaggactatctctgacatattagccacaacctcaaaggcaaagaataatagaatagcacctatggaatatggaaagaaaaggctatactccccacattctgtacctagtgaagatgtttccataaagtacacaggccacagagatatgctcatatagaatgtggctcaaaaatatactgtagacatattgtccattagaaagaatgccaggaggtagttatttgagatattaactgaaaggaagatcatgaaaatattgaatgcacacaatgaagaaaagaacttgggtgagcaccggttgtagtgaaggacatagattatgcaaatgtttgcatgcatgtggtgaaaaattaatggaagatcaagaattacccattaaactgaagatatgtaatataaaacttaataataatgcatacatgtagagaaaattctcaacagaattaagatccaaatgcaaacagtgattacttctgattggttttggataggattataagttattttaattttattctttaccctatttaaaaatgtaaaacccttctacaattggcatctattactcatagagtaataattaatattgagaaaaatacattttttcaggatagattgatgaggaagagagagagaaagtcatcaaaacgccttgtagtcagaagaacgcatatatttcttttaatagtttgttagattgaattaactttttactcttacatatttcactgatatctcataatgaattaattaaaacaacgtaaactttccacatatattgatgataagacaagtttttccttttggtagatgcttacagacatctgggcattaatacttctaaagatatacattttataggagtaatgaacccgaaagtgagtacttgaattggagacatcttaagtatcttgctatcataatggatattggacaaaagcacagatgtgcatttttaccaatgacaaataaacagagtctggaaaccataacagatgtagccataatgagaacactaaatgagaaaactaattttgtacattcatacattgctgtgggccaattcctggaaagaaaagccggaatataaatgataataacaatcaaacaaagaaaaattattcaaatgtactcaacatgtacattttgaaacgtcatttctgaaaacttgtgaagtaatgtcgtaaagacttcagtgagattcttctactcaattctggtgttgaaactatgccccttttacttaggagccttggaccttttaccaacatcattgtctcaagattctatcacaatacaattgttacctacctagagtactgagtgctcaacatacaatgaaatctacaacccaattacagagattgtccattgcaataatgtgttttttacagcaagggtatcaaagactacaaatgattttcctagtctcataggaaattgatcagactggtatccagaaaatcagggttgtagttctcactctggtaccaattatgcttgacctcagataagttagtagagtaagcttatgcctcagtttccttacctgcacccactcaccaaccttggctacacttcctctacagtaggctccatcacgtctcgtaggattcctctttatgagacagggcatagctatcctctctttctttggatccatgaagagagttctgctttctaacgttttacaattttaaagaacaaggggtatcatgggaaggtgcagggtagtgtgagggtgagcccatgccgttgcaattgctcctacctgctgctttttgctcagggatctaggacaaccaaggaccttaggtaggagagtaagcttccacctgtgtcttgtttgttctttctttattcattactcttatttttgagaaaatatccattatttatttaagtaactccaagtccatcttcctttttgaaaaataagagtaaaatctttttagcaccaatttaaagatatatttgcttgatttttaatgtatgtttaattctatgcagctgctttcaacgaatgactatgattctaaaaacatctaatgtagtgattgataagctaaattgcaagataaaaatgaaaagttcacccagtgttcctaaaccaaaacattgcatgggtttcaccctgcacctctctgccacccctccagtcttcccactgaagctccagggcagccctgtaggactgtactttccttgcactccagccctgtgctggggtatcctgtgcatctggaatctacctttccttagaaagctccccgacttcctcccaccctgctgcacccaacctcttaggtgaccttacacaggacatagtcctgtgagtgggctatagtaccctcaccatggtgtgtccctcccatcagactgctgcggcataatgggcagagaaaagatgcgtgttgaatgaattctccgttctgtgaaggaagaggaatcaaatctctatttgacccttggtgaaactcaattactgtccagtgccccggttttcaccaccaaaatcataacaaagtcagaacattctttaacccttggcctgacaggggcaggctgttgtcttataaaagctggtggtcaatgtccagtggagggaggtggggagtgaactcaagactgacagcaggtccagggttttctctacttacttgatgacattattttcctaaacactgtggtctaagccctctcattctctgtgtattagctttgaaagataattttttaatttcagagtaaaaacatgggaatgttaagccccaaaatgcttaggaattgtccaagagctctgagcactaagcagaaaggccccattccaaggccatgaggattccctagagcgccccatgagaggaactgtagatcagtgtgttctttaatagagtctttaaatatttactctatgacaatcatgtaaattataggactctaaagcctgtgccaaatgaaaatctgtggcccctctgaattatttatgagtaagggacctaggaagagagaggcagccactgtagtttgtgggggttcaggtatttgcaccagtggttttttacttctaagacctaagtagagacagagctcatggaagattacagctatgtgcaaaaaatcggaaaaggcaggatggctgccatcagtgggctgtctcctgaagttcattacgtgaaatttatcagctgctctcttctgctgtcatagttgaggttttcatttctatgttatgctgtcattgggatccattgcggctcattgtagaggcaggattttcagtgctctgtatgttagtaggtgatttgatgagagagacacatacctgtgactccagacatgtgggttctgcctgtgtcaggagcaggttctaaactccaggaaaagtcacaacattcctctgattctgtttctgcttctggaacacaagggcctgtccaagctagaccacttcatgggatttcattttcctaaaagaatctataattctaaaatgctgaaagctgacttacaaagaactgtgcatagcatactagcttccttaacacaatttcaccatcagattactgaatgagaaaatgtattatgaaaacttccaggagagggtctggcacgttggggaattactaactacaggagcagtcaatcatttcaccagcgagatgggagaccagatgtactctcgcctcctagatgaaaaccctaaaagaatgacacaaatccaggaaatgtgctaaaatgaagggcaataaattcataacagaagaactaggatacagaaagcaaatatgagaacactgtttttaatctttcagcagtgactgtcatggtttaaggtaagaaaaggtatttatgcgacttgatcaaataaagatccaaccttggtagtttaatattttattattgagctccccacagaaacagcagtgttcttttggcagcttttcactgaagaatgaatagaacagaggccttcaacttccagccctgtatccttcccactgtatggctatagtcttaggaaaaccagacacgtgtgctgaagaagggtgtatgatatgctggcagggaaatagttgtggtgtctgcagactaaggcctgaatctcagctgtgtcatagctgtcagtctataggaacatttcctaaatatctgtgcttcagatactgcttctgtaaacaggcataataattctgatgtgacatagttgctctatcagaatttatacaaatagtctaatgtcctaaatagcatacagcacatggctacaggctaatttttgtgtatttctggctaccaactctttctctctgctcacaagtttgaaaggacttagagtttgagattttcctctcctcctttttgcccatcttcatactcctgaaaatttaattaatcctttttttgtgaggataactaagatctaatttctcagcaaatgtttagtatgcaaaacattattaactgtagttgccatgctatacattaggtctccagaacttatttacatatttacttatgtatgtatttatttattgagagagatgaggtctcactctgttgcccaggctggaatgcagtggcgcaatcatggttcactgcagcctcagactcctgggctcaagcagtcctcccacctcagcctttcaagtagctgccactacagttgcatgccaccatgccctgataattaaaacaatttgtttggtagaaatggggtctctccatgttgtccaggctggcctcaaactcttgggcttaagcaatcttccttccttggcctcccaaagggctgagattacaggtgtgagctaccatgcccaggctttatttatcttatgtctggaattttgtatcctttgactaacatctccccattgcctctttcccctggcctgaggtgacagccttctactctctctttctgtgaatttgacttttaaaagttccacacataaatgagattttgcagtgtttgtctttctttgcctgacttatttctcttaacataatgtctttcatgttcattcatgttgtctccaagacaggatttccttctcttttgaagctgagtaatgttccattatgtgcatgaatatctatcttatattttctgtatccactcatttatcaacagacacaggttattttcatatcttggctattgtgaataatgctgcaatgcacatgggcctgcagatatctcttcaagataatattttattttactttattttttgacatacatctagaaatgggtttgctggagcatatggtagatctatttttaattttctgaggcacccctatagtgttttccataagggctgtactaatttacattcccaccagcaggataaaaattgtgataatcattttgtaatgtatacatatatcaaaacattacatagtacaccttaaatgtttgcaattattatttgtcagttatacctgaataaagctggaaacaaaacaaacaaaatgaaagcaataataattgaaaaccaaggaaattaaattcagcgttggacagacatgaggcaggagtggggtgtcagcagggttggacaggaagcataagcaaatgacaacatatgcctgcagccatagagtttggggaaatgatagcaatccagcttttcaaatgggagcagtgggagaatacaaagattgggtttcactttaaaggagatctgtgtctaggtaaagaatatgggctctatatttttctatttctttctggaagttctctaggctttctgggtgagggattcatgagtgtgcggagaggtgagctgagcagggatgcacatgtttgtgagtgaggcctggcactgcgaggatggagttcacgtgaaagtaacaggactcggtaacttcttggatgtgtggggtgaagaagagcagggagatggggagggcttagtgttttttgagcctgggtgactgggaagatgatggggatatttgccccagggtgtgtgtgtgtatatttaggttaaacaatttcagtattctactgtgttcctcaaataatataattccaagacatgtactcagctaaccacatttctctggatcctcttaatccagagtgttctcattcttacgtagagtctagaagagcacacaacattgcaaatatactccacagcaccagtggtccacgggccatactttggcaggatctgatactttataaacactgtctaatgtcgcttggctttttctgacctcctgataaggttggttgacattgggctgcacatcaagtgagaagctccctgtgagtcaacactttagctaggaaggacaggactggcaggccccatgaggtgtaggctagaaataaagcttggtgaaagaaagacacataggagaaagactggtgggtgttattggtccagacaggtgagggatcaagaccacacaattcagttcatgatgaatgtggtaagtccaggatccaggaagcgatgcagcaggtgtcaggcacacacactgcgagcctggaccagaatatctggacagtattaatttataatcaaaatttattctggaaaactgtacagtggatttgctgaaccaacagctcctactgttgttgcttttatgagccggaacttgccttagtacgtggctgagttcccaatagaaggaaaaaaaaggctggcatagctggggagaagagcaggtggcaaagggacagaagtccagatgcctggtcgcaaagctgttggaagtttggagcactgtagcctgttccaactctgtaccttttttgtaggcttacttataccccatgatgtttcagtaaggatttaatgtgctctcataaagcagtgccgataagataataccgataagatgaattaaaatacaggtgatagtataaattaaaatacagatgatagggtaaattaaaggcgagccaaaagaaaaataagcaaaatctaggactggcaacatgaaatggagcaaggatttgtgcctttggtaatggcctccacatacaagccacacatttgactccaatcactgacacaaccaattaggcaaaggaaatctgattactctcacagtccacaatgtccaagataaaacacgaaccaactttatttatggagttcttcttaacacaatattgactagaatttctggggaagcactgtcccactctgtgatattataaacagctcttataataaaatgcttttaattgataagctgatggcagtttcttcattttggccgctggcatcacacacatgcgcaagcccaagaaagcaaacaaagcaaaacaaaacaaacaactccaaaaccaaaattggttcagtgaaacagtcgttatctatctatctagatgtggcttgatctagaggtgaatattgatctgattcatatcagatagtcttctttgcatattgttacttagcctgagtatgtttcctctctgcaaacataggctatgggatacttatgaggattacacaataaaacatgagaacctatgaacatagggcctgtcatgtaaagcatgaacaattcatgctggttatgtttgacaacaacagcaatgacagaaatcccagcacatatttgctgaatttcacaatggaatttgccatttttttctgctaattgaccagggcctgggcaaagcaagcaggatacattgtgatggcacagggaatctgcgtagcctgtagatgagctgcgattcaccatgcaggagcaggctgaaggctcacttttcaatttgtctttcacaggaataacactctacagccacccatatggaggggccttgctgaacaaggacaagatgtgagttgatggaatgctgaggggtgtgtgaccctgactatggaagaaaatctttgtgttacttagggatgactttggtctctcttttgcatttgccccaagagatggcttatagagttagcaggaaatgcccacaggacttgggcatttctttgcaaagtgtgagaaaaacgactattaagagagtcagtacattgactgagcttaaaacagatgagtttgtcatgcaactgtacttctaagcagaaattcttctaagggaatgatttaccagaaacttatgggactgtacatcttctgaagagttttcggggttaaaatcataaacattgcattcatgtacataaacatagtaacgcctccttgaatatttctcatgcaagattttcctcctgatccagatggagacatgggtggggataaggccagagctcttcaggtacagaattctgtgtcagttctcactgtctttgtaaagggtagcatgcttccacctgtcttctctttttctcccccatctcccttctctattatatggtcgacaaacttttaattaaaagtcgataataaaagtgggtatttttgaaaaactttttatgacctaccaaattaagtcgcagaatgcaaatctgcttaatgggcattctctgctcaagttgttaatctggcaggaaccggcaggaagcaccggttgggttgcagcttgtcctcacgttcacttaatgattttcagggttctagctttaacagtgtctgacacctgccagaattccaagagtaggctagctgacatctgttgtagaatgcgacacgatggagcagaaggcatggcacagcagatgacttgtgctgaggagttccatcgtgtcggcctcctgaaagaccatctgtggtctgactgttcctaaaggagttgagaggaggcagcaattgacttgagtaaaagtagtagtgttccaggtaaaacaattactaagaaaatgtacagtgtataatattacagagcacctcaatctattgcaaaatcttgttggtatttcatgtgactaaattcagagatgggccagtgcagtgtggagctgtagtgaaggctcctctctggcaggtgctactgtattgcaaagcagtccctgtgtgggcaaaggtcacagcttacccggatgctgctcagaggatatctttcatcttaattgggagtcaggctcaatggtgaagagcagattttgacacaagaagactccgaaatgccctcaaactgtgctcctcagttttgtcttctgtaaactgagcttagtcatccatgtctcaaaaggtggctgaggggatttaatgagggaatccatgcccttagccaacatgcctggctgattatgaatttttaattagcagttttcactgctgtcatcattgctgattgttattagcaaagaaggcttgtgttcttcgtcaggtgcctgagagctgctctgttccacccgcagcctggagagcatccgtcagtgtggagtggccctctgcatcgtgctgggattctccatcctgtctgcatccatcggcagctctgtggtgagggacagggtgattggagccaaaaggttgcagcacataagtggccttggctacaggatgtactggttcacaaacttcctatatgacatggtaggatttgggaatgagattctgtgtgcctccacaatagtgatctaaatagtgcgtgtatggagggatggaggggggcattggggccctggctgccttggagtgtccacaaaaaggggtcatcttattgataagagcatttcagattaagtcacctttactgatcaccatagaattggttcataaggggaagactgataagcttcaggctggagaactgggaaattatagaactttacaaagatgcaaagtttcttattgagaagatgagaaaattattacctttactatgctcttttcaatggggtagcagatgaggtgataaaaatcattagaaatgatctttcatctgcatgcttaacaccccctcctgtgagacctgtgcctcattgcctaataggtatggcgggtattattagcatttttggaatgcactcagtttcccaatggaaaccctccagatcagtgtctgccatcctgggggacaataacagatgctttgtctaggtgttccctattcttcaggacatttatcttaagtaaaaaaaagcatcttatatgataagttgttcttagtggtcaatatctactgtcattgttctctggtggagctgtctttattttgtaggaaagtgatatccttgccctcatacatatgattcatcttgtgatacagaaaatcatacataagtcagtggaaggccggaggtcaaccatttactgagcaccttccatgcactaggtgctgtctgagctgtgctacaccaggcacaaatttccgcatattaacatgttgctttcctgtaaggtttatttctttgagctggcttagaatttagctaatttattttcttttgatcatgtaacttggatttttgttttgttttgaaagtacaatttatcggggtcacacctaagttacctaacatttcaggagttcatttaatttaatcagaggtttccctgaacctgcctggtgatagatatcacctgggacatttggtaacaataaggattcccaagggcctatccttcgagattctattcagtaggactggggggacttggaggtctgtgttttactaggtactcaaggtgatttatgaatcttaaccaagattgacaaattctgggtctttaaacccttatctttactgagggacacttgaaggcaggcaagtggaagtgacttgtccaagattttacatctagttggtacagagatggcttctcagtgccagcctctgtctcctggtccagttttgttccctgtgctacacactgctgctggctacttgtctctctgccgtctgtcatttaacagtgtctaagggccacaactttcccagataaaagggaagaagtgtgtggcaagagagaatcacaacacacagggggccacgtttctaggacaccatggggctttcaaagtctccaaaaccccaggatcttccttcttttcagcacccttagtttattatctctttatgcctcccactcagtctgactcttctttactctgtgatgtttgatcttggtgattaaggacaggaagggtttcttgcttcttgcttggatggttttccatcttcatccaatcattctctgcttattctattcaatcactaatttaataaatatttttgaggatctgttgtgggtcaaggtgggtccaaggttgctatagactaaatgattatgtccccccaaaattcatgttgacacctaatccccagtgtgatggtatttggatgtgggatcttggagagataattaggttctgagaatggagccctcctgaatgggattaatggccttgtaaaagaggccgcagagagctctatgtgaggacacagtgagaagtcacagcctgaacgaggaagctggccctcgccagtcaccgaatctgccagcaccttgattctggtctttccagcctccagaactgtgagcaataaagttgtgtggtttataagatacttggtctgtgttattctgtcatagccccccaaatggtgttgggcataaagccatgcataaagcagagaagattgctccctcaaagagattcttatgagaggaagcagaaaaactagtaaacaaacaaataaataaatgcgcaggatacagttggccatgactgggtctgttgaaagaatgaaagagattgatgggatggaggatgacttcaaatgtgaaggtcaaagaagacagtgaaactttacctgagatctgtgaggtaagaaggggccctgcccatggatgacgtgcaggaagaggtctgcagcttgaggctctaagagaagaaggaaccaggcgtgtgagagcctgaaggaaagccatggctattgttggcctgcagggagcaccttaaggtgaggctggatagggaggtagtgtgaggagcctgtccttggttctacgtgtgtgggaggaggctgtgtttcatgaaagctgattggattccttgaccctcctcaaaggagatggatatgcatgacagtagtagtcacctcaggccaccataacaaaataccacaggctgggtagcttcaccccggaaacttgattctctcattgtcctggaggctggaagtctgagatcaaggtgttggcagggttgattccttctgaggcttctctccttggcttgtggacagccatcctctccctgtgtcctcacatgtcagccctctgagagtgactgcatcctgatctcctctagagacaccagtcatgttggatgagggctcacccaattgacttcattttaccttaatcacttgttcaaagtcctgtcttcaaatacagtcacatcttgaaatactgggggttcaatgtataaattgtgggggggtacaactcagattaaaacaagcgactttccaggactaattccacggctacagaactcctaatgtgcaaaataggaaatatatttgtgaagttgaaaggaaacttcaggataagtagatgataataaatatgaccatctgatgtaacagctctcccttatttctttttatcttctcagctcttttacttggtttccgtctgcctgtgtgttgccgttattgtcgccttccagttaacagcttttactttccgcaagaacttggcagccacggccctcctgctgtcacttttcgggtatgtgatgagaaacgctgctgcagaattacggtttgttttctgaaagagaaaaccctcaggatggctttgaacctgctgtcgacttcatgatttcctctcttttgaagcaattatgttgcttctgcaagggacacggagcaaacaagcctgagcaggatgatgaatgccccgtggaggaaggaagggctgacctggtcgtgatgaagacagcactgccctgtctcagacaggcccttgagctgtttgacaaacttgtgcagctggaaatggattctctattattctcactttgacattaatcaggggctcaaatacataatccaattaactcggagattgcatttgtggaggttctctcagcaagctctctggcattttttctcctctcctctaatattagtagtttgaaaatgttttgtctaatttctatcacttttttttcagatgaaaaaatagcaaatggagaaaagtcattttatgaatttctgatttatgcatgctagtcaggatcattgctagtggcctcaaaattatatctatccggtatcaggatatatatgtcttcttatttgtcatgcacgtatgcttatatacaggctaactacataagagatgcttagtagggaaaatcattatcatactaatttattatacttcaaggctattttaaaagataaaacagcttgctcttatttaagaggattacaaatgaagtgatttttacagtttgtatttatataagtgccctagaattattcaaaacatctaattagagacagagttttacttaaacaaatatataccattactagatgattgtataggtgggtgggtggatggatggaagtatgtagataagagaaagaaagatagacagggagagagagattaacagagagagggaaagagacactaagagagagagggagagagagattaagagagagagagaaacaagacagacagacaaacttttgggggaacattgatattactactcactaaccccaatgctgtagctttggtaatactaattattctgtctaatcctcagttttttctttgtaaaacttcatgtcttttgctataaagattaaatagtttatatgaatatcatggacaatgactggtacaaaattcccattaaattaattttagccattattgttactctttagaattattttactctttagaagatgtaatatcctgagctataaaacatgcttatagtagacatatatttattatatttagctagaaatttatggacttgtgtataaagatctatgtgtgtgtacccagctctaagaacacagtttgatttcagtttattgatccaattgaatggatagtgttgtcatgtctccctctatttcaagtaaaatagactttgctataaaattatttttgaattttaggagagtatatctcaaaaactgagttaaaacttagatgaaatggttagaaagccttgaaaacacgcttttagaaatttttattagttgttttgattgtgaaaccctttaagaatttgaattaaactaagaattctcttcatacataactaccacatttttcaaagaatttctggagattcacaggtctgttgaagcacaatcataggcaataggggttacacgcttctggttaagaactcttaggttgcagagactggaaagatgtcagagataactcagaccgtgtttgtaatcatggctaatcccagggaagaagagcccccaaggaaagtttatcagggtcactgggtgacatccatgggaatgcagatttagaaggtagctctttcttcattggagcacagccagtggaactggtgacaacctcccccgccactgtaacaggaggggcagtgagagacccggtctggggaactgctgtctcctgtgtgcctggcaatctctgggtgaggatagcagaattggctcatgcctgctgtccttctaaggacctatgggtacacggagcccaagggcaaactcaggaaagctgaatcccgagctgaaacctaagagcacgtccaggcattaaatggctgcttaaaggcaggaatctgaaggaataagggatagtatacacgaattgattcttttaagagataacaagataaacatgcctaatcgcagtcttattgtttttcttctttctatcaaggacaatttgttatttaaactataaaagggagagtcagggagaattagcatccaaaagagggaagtaacacctaaaatgaatgaaagaaaacagagcctaacttacataaagatggaaaccttaagaacatatttgatgtatatttaccgctaaaagatgagattgcagaatcctgcttggtgtcttgggaaatccacaaagcatggggaagcggccgattttcaaaaggggaattttcttccgccataaattccatgatgttgtgaacagtaggccagtctctagcaaattttaaaatcattaaaatgatattatattttaataaaagcctggagattgttgaaattcattgtaattttcacaaaaaaataaatataagccaatttcatttttttcttataaaataggagacgggagctgctaatacgttaatttgagccaagtattttaaagataactaatgaaaatgtagtaaaaaaagtgatggaatcatagcccgttgaaaaccacactggaatactcttcattcatctagcaataggaactctcatgtggcttcatttaggacaatgtctctgattctttgtttttcttaaataatgctttgatccacttgtcaaatatttaaatgacataacccaacatggaaaccttatgtaataagtaactagatacagatcctgaaccatctcaaaggaagtagagcctaatgttgaggtggtaattagtcactcaagtgcagatcaggtatgcagactccacagcaagaccgggaggctgctgtacccttagattgtattgctggatgtggagatgctgatcaaagcagatgataatcttgctgtgtgttgtgccaggccaaccacatcatgttctctgtgaggtagctttacctaaactcccctaagtcccacaatgcaaaatttaacagagagagctggttgaatatcgtgttgttaaaggagcagagaaagacccagtcttttgtagtggaggtttaagcagaataacatggctatcctcagctatttaaaggactgtcacatggaaaagaaaagcaatttgtcacgtgctgttccagaatatagagtttgaatcagtagctataagttggagagagttttcattcactcttagaatgaattttatagcaattacagctgccccaaaatttggctcacaaacttctactactgcttatatttctgttgcaaaaatacttgcaattctgtgatttcatttgattctcaaaacagttgcgtgaaggagtgtagcacttgatttttgtctcagaaggcacagtaaaggaaagagggtaggtgtgtggtgtgggtgaatatgtgttggggtttgaattctctctgtggtagtttatttcagacagagatgttgataatgtacagccctaagaagtcatgacttatctctctggtaattattttgatttaattagttgattgtcttatgtagcaactgttttagaacagctcttgcctccattgtgtgctttgaaataattaatgcccacattttgaggcagattgctattgagtagagtgtctaaaacactatatgattttatatatcatattatatatatcttatgaactatgagaatgtatcttttaacccaggaaagcattccaacatcatggatgtcatatgaaagggggtgcatactagactaagagttaacttgagggcctggcatctcttatatcattttgaagtctcatacttttcagaacttgttaacatattaggaaaacctcagacattttgcaggcactgaagtgtttcaggttaatccaattattcaccataagaaaacagtgatacatttaccttgagtgagcagagaacttgttggagctccggatatatgagaatcttttgggaaagttgtgattcaaaatcagtgacttctctgctgatattaggaaccatcgttcaaagtgtacttcctttattgggtgcagtggtattatttcaggaaggagatgagggaagttgccatgagtgaaacctggctctagaattgaggagacggaatgaagaaaatgagatgttttccttttagggacatttgggtggtatcttagatcctgatgtcatctgacacatgtggggactgcttctagggttcaatgtttagcaatgcttcttactccccagctttggggccacatggaaatgaatcccatgttcatctacttatcacctgcaaagctcgatcaagtgtctgaactctgcaaatccccattgttctgcctgtaagatgacagttacagtgctgtctcctggcttgctggggactaaaggaagattagggcacactgaggagttacagatggtaccccctgtgcagtggatgctggaaggaggctttcagtttttatttttaggccttattttttttacgtagctctgcagctttttatattcttgatatcttttgattctcaatataatgaataagtattattcctgccttcctgatgagaagcagagcagagaagctccttttggagaagagaggttggagaagtcagccgactttctccaggccacagagccgacaagttcaggcccacgtacaacccgtgtgtgtgttgtgaccccatccggtgttctttattgcattgcagagtcctctgaagccccaggaagagtgtgttgtctttgaaaaataccgtggaatgtattatgtaaagttcatttctgttcaccaagtgaggaaaaattgctgggccaataaaattgcatctataattcagtcttacggctgtccccttatctgcatttttgctttcagagaattcggttacccacagtcaactgtggtctcaagatattaaatggaaaattccagaaataaacaattcatcagttttaaagggcacagtgttctgagtagcaggatgaaatcttgtactgtcttgctctatcccatcagagacgtgaatttcccctttgtcctgcatatcctcactttggacctgggagtcagtgagttaccaaattgactgtcgcagcatggcagtgcttgtgttcaagggacctttgttttactagatggccccaaagtgctagagtaggcacgctggcatattgctgtaattgttctattttatactactcattgttcttaatctctcactgtgcctaatttataaatcaaaccttatcataggttgtatgtatggggaaaaacatagtatatgtaggattcagtaatatctgcattttcagggattcaccccaaggtcttagaatgtatctgccatagataaaactactgtaaatgttacagtaaaacaaacattacttttcactttacttttcagatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaaggtcagtagctttgtagcatcacctctacacttctgcacctctagtgcaaagacggtgttaactcatgcctcttttgttgcttttctgactggaattcaatggaaatgcattggtatccactgtctttaaactccagagagataaatggattctaattaacaaaaaacacattgccgttataaaagccatgcctaggcttagcaacaattgacgaaaaaatgttctgtttcggccactccattcttgagggtagagccatgaagatgttcactgccgcatccctagcattttcatcagagactatttattgatgaattactgatgaatggtggaagagtgagtcattgaaacatgccctctcaatgttcaccatcgtttgggtcagacactacaagatagaatgggccacacaacacagctgaccatgctctcggggcacagcatgtctgaatgatgatctggcgggattctaccctcttctctgggatttctggaacaaatttaattttgctgttttccaagcatggcagccaagggctttcctgagcctgaggcccgtggtcaggaagaacttctccttgtgaggtcaacgccactctccaataggccgttctgattagcaagtcatttcttaaatgtcatctccagctggtgtctaggtcaaggtgaacccattagtcctgccacattcctttcactcctgtctcctcccttagtgaggcctgcctgggtgtttgcctctgctttaatacatctttcagcccctcagcatccccagtgctacctggagatacagacttcagattttgcactttcctctgcacccttattgcaatccttttcattctgttttcttttctcagctctgaccacactattctctcctgattccctgctgcttatatggagtctgattcctcagtagttcccaaatgtttggccagctcaggggctgagaaatgacctggaaaaggtactgagctcctagttttgaagcatgtgctgcagttctcatttcaaatcaaacagggactgatgcctatttaattgggatgagtctacttcctcatggctggactttcagagacttagtaaatttgccactgatagctaacattagtttttattactgtgcttcatatttggatagaagcagtgaactctgtaaacatctattatgcattcagtgatggtaataatctattttggtgatttttacagatttattattgacactgatttatattaatatgtctacactttaaagagaaaacttgcagaaccattgattggctttagcttgaggagaaaattgaaatcagtagagatagtgtacaatttccctcctccctcatcggatctctagcatgacatgaaccatcaggatgtcagtcatgaatcatggtgaaactgaaaagagactcacagtagataatcctattggtgaggaacttgaaagcagagagcttccctggggagtggagtcacagaagtgagatttagctccaaaagaaaaacgaagaagaattgtccatatccaaagaggaagctgaccaggaacctttccactcatgaggttttaccagtgtggcaagtggaaagccttgttacctttaattataaacagcattgcttacttgttaaaaaaaaaatcaacaggcaatgaagtgtttgccagaaaatggatctaaatcaattggtaacaagtaattaaaagcagcttattgcttttgtttgggtctttcttttcctttgctctttattttgatattatttgcttaggaagcaaccttattcaaatgtttatttcaaataatttcaaattttcatttgtaggttatggagctttgtagcattaattcttatagaattaatgaaagaaaccaaaaaaggtgactggattctcagatcactctttttcttaaaaaataaaaatattttaagttctggggtacatgtgcaggatatgcaggtttgttccatagataaatgtgtgccatggtggtttgctgcacctctcaacccatcacctaggtattaagcccagcatgcattagctatttttcgtaatgctctccctcccccaccccatcccccaacaggccccagtgtgtgttgttcctgtccttgtgttcatgcgttctcattgctcagctcccacttataagtgggaatatgcagtgtttggttttctgttcctacattagttttctgaggataatggctttcttgctccatccatgtccctgcaaaggacatgatctccttcctttttatggctgcattgtattctatggtgtatccatctatccagtctatcattgatgggcatttgggttgattccacgtctttgctattgtgaatagtgctgcagtgaacatatgtgtgcacatatctttggaatagaatgatttatattcctttgggtttatacccagtaatgagattgctgggtcaaatcgtatttctggttctagatctttgaggaattgccacaccatcttccacagtggtgaacaataagtctgaatatctagtgtaaccagtattaaccattgtgtttacaaattatagtgttaattaatcattttcattgttaccaaatcacagtttatatgatgacacattttgatttcaaacacaagatctggaacatctgtctttcccactggtgaggctccctgttggagcgagggggatgtgggggagcaaaaactcatgttttctaatttatttctttgtataattatcattttcacataatcctaaatcgaacacttatggattgttattctgtgagtttgtgcacctgcatcccccttctatgtatggattatttgttaactcagtgttcatatattgctaacacctttgttcatacttgtgtagagatcattgtgatttccttaaaagtagatgtaaaaatcatcactgttctcaagcaagaaaaccttgaaaggcaaataccagtagatctaattaatatctctaaacaaaatacctttgttttgatggctgtctgagaatatcagtgaatagttgggatagggaagacctggaacacagagctaaccaaggagaaaaagaagttattggtatatattatgaaaaggggaatagcttttaattggattttttttctttttttcactgtgcagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgaactttctgggctggatcttcgtgcaactggcctcgcagggcacagtacttctcctcttgagggttctgctacactgggaccttctgcgatggccaaggtgggttctgaaggactcatcctcgagctgcacttactcctgcaaaatgagaggaagagaaaaattcatcctggaggttgtaaaataaaaattatatctgatcagcattatacatagttctaatgcgttaagattttattattttttaaacattgattggtgtcagtcacccacaccaggaaggaaaatttcaaaggataaggtgacaaactgtgagatgatctttccaattatttgtctcagcatattttctttttttaaaattttttttattgtactttaagttctatggtacatgtgcacaatgtgcaggtttgttacatatgtatacatgagccatgttggtgtgctgcacccattaactcatcgtttacattagatatatctctgaatgctatccctcccctctccaaccaccccacaacaggccccggtgtgtgatgttccccttcctgtgtccaagtgttctcattgttcaattccaacctatgagtgagaacatattttcactttgaaattgctgaatttctctgttactttgaagcagctaaggtaaatttggttaataccataacattatttttacaactaaatgccaagaactctgggagcaggaagataggaaaattcagtacagatgtctgtgtgtcctttgctggatcttgttgcttatgctgctgtactctgatctttgtcaggtgaggtcgaaagtcagtagcatggggcatgtgtagacatgtagatatataatgtggtttatacacatgcatgcacacacatgcattcctactactataaataggatttaatgtggccttgaaaggatatctgaaatattgtcagataaaacatttgaactgcataaggaagcaatgtgctttcctgtgtagggtccacaatggttggcttcccccccatacccaagtggcctgaattcattggcctgctctttccaagggctatgtatttccgtctgacctctacttgagggagggatcctttttggagaaattaccaattaagaccatgtcactagaaaatctattaaggattataaagacacatgattaataatttatggtgatctcttcatagaattatttttcctttcagccatttcctgacatattttgttacataaccccttttaataaagtaaaatagacaccgttttgagtataaatcccaatgtgcttttgaattggccacatcaccctggagtctgcagatttccaatagctgactgaacctggagtaaaatgcagagtgccctttaaacataatttgttctctgatgtcccttactagtttagtctattttataaaactgtaatgtaggatcccccttggcagatttcagggtactccattttcctatagtatcaaaagatttttctttaaagagaaaaatctgtattacctttactttctagagttgtaagtataagttgaattgtattttagaataatatccttgttacccacagtaaagagtcaatttttttctctacatgaaggttacagagcatagaaatttaagtgaatttagacactagttgcctactaccattttatggataactgtcataatgactgcatgacccagtcaatttacttttaagacccagatctaactaagccactaatcattgtttgaaaggtaaagcccaaggttcttagcaagcccccctgaagtgtggtgccttctgctcagtgaaggtgtctgtgatcctcctcccatcccacagggatatttgttgccctgcctctggggctgggctgatgccttctccgtgtttctgttacgccctctttctctattagggcacatctatgttggtttatggtatcgatatgctactcataattgaatcttgcaagaaaatagggagaccctgccctgtgcaactgggaatggatagatcctgccttcccagcctgagcagggcccctgtcacctgcacccactgctggacatgagtgctgagatcccacttccttgctgtccttccctaacctgcgctgactcctgtccagctgtcccactgtcctgctgctggccttgggttgtttgccatgaattcaggtttccattaggacctgagccctagttcctgcctattttgtctcctgcctagagctgcacttttgctgtctgtaccctaggtgctggctgggttggaacagccacactgttcagatatgagatatgctgcatatctggaaagttctgctatacctaggtcccatctgaattcttcctatttaatacagggatcgtttgttagtcattttcagttagaggataactaagtggcacatttctgggcatagttggattcctgtattaggacactggattgttgtgagtgggtggaccagaagtaagctcagtcaattgtctccaccaaccagaattacttgaagagatttaaatgaatgtgcacacctgggcccctccctagaactctgcaatgagaagctctggggatgagacccaggagctgttcataaagcttcccaggtaatcctcctgaggagagaatgagcaagctgatgtgggttactgtgaatactactctgccaggcaggagggaatacagtggcacaacttcctgttggagtgggaagacttccaaaagtccaggatagggtgaaaggtcaataaacacaccttcatctgggagagggaaataacattcaaacagaaaagtgtaaaattcaatgaattttcacaaattgaacacattgatgtagccccctctcactaataaactgaatactgccaacacttcagatggcctctcataaacttctccatcaatagctgcaccctaggtaactgcaatccttatttttatttttattgattcatttttcttgcctttgaacgttatataaatgaggtcatgtaagatagaattctgagtatctagctatatttttctcatcgtctatgttctctgtagaataaattatatattgtcaaatggtgattttatatgtggaaaaataataaagaaaagttgctggggatactgggagcttgccatggatattggattttatttttaataccttttttattttgaaatagtttaataatcagaagaagttgtaaaattattatcgaacattgctatgtaccttacacccagcttctcccaatgataatataataatatattacatggcaatttacactgtcaaagccaggtaattgatgttggttatgatactaactcagtcgttatcattaaaatataatcattaaatatattttaaatgattaaatataataattaaaatgttggcatattatagtttataggggaaattgaaatttattggaaagttaaatgtgtcagattgcaaattagaaagaagattaaaaagtgagcagctcagatttagagaaaataagagttgaaaattaaatttgcattcctctgatagatacttactgaatactttttgcaaagtattgtgcaaagtgctggttatataatccttttatgcgattcaacatatactataaacttacaatgtttcagtacttttatatacaatctacattattaaatgacttgtttagtaaaaagcacttaataagtaaatgccttataataattttgtgataagctattttaacatttagtacaattaatctggcatgatcttattcataaaattaaaaactagctctagtttagtgccaattcatttcagtatcttttaggaatgtatatatttcatttatgttagacaataaaaaatggattcttgcctgataatcaggatggcagaactggggtgctctggacaaagctgactgcccagaagtccgaaggtgatatcttcaattttttacaaatctctgacctttttgcctcttctagactattctggtatcatttgctaggtgtgaattcactctgatttcatcttcccaggggtcattctactctccaaggcacagtcaaatcttctaaggatacagatgttgaaaaagaggaaaagagagtgtttgaaggaaggaccaatggagacattcttgtgttatacaaccttagtaaacattatcgacgctttttccagaatattattgctgtgcaagatattagtttgggcataccaaaaggagaggtaatgaagcttctatttttaatcttcttctgttgtgaacctgtacaactctagtagctgatctgcttgtgttagtctcagaatatttgaaatcagagccaaaaatagccttcaaattttagaaattcctacaaaatcagtaggagcagaaccaaatagagggtctgttgactatttcatagtaaaaacttggctgattgataggatttattttgttttataatgttaaaaatttcatgtgattgcatagttttaattatgacttgggctatgggataactttttgttgagcaaatatttttttgaatctaattaaggaaccacttttatctcttactgggacatcagtactctaagtgtccaattaagcccatctggcaaaatgctactcagaaaaggtaaagaacactcatccacctagcaatagctcaggaatttttgttcacaggtaagacattaattctagttataatgtttaatcagaactgacagaagccatataaattgttcctgatttatgcttaatgtgtaaagggaaatcagttctggaagtgattgccttcaattaactgttaaaaataaaagagcaccttgcattcatacggttcccagctcctgagaaattcaaaataggttatattgttatctgattggtatctatattctacttgtgatctgacagtaggtgtctcagatatgtgtattctgaggtaaagagaagccgagagatcaatctgaagtaatgcaggcatattcttactctctgaactatgatttctggtagattagaacaaaatgttaagaaaggatttttttttttagtagttgttagcttctgctctaagactggctatgcaatcttacccatcttattgaactattttttgtacccttgctttaaaaatcatgattattatagttttgccggtacctctccatagtagtttgaggcaaaggggtgtgggagggccaagattcactgaaaatcaactgacaaaaggcagagtaacaggaaaaaggcatatgaatttatttgattatagttttacgtgatacgagagccttcagaatgaagacccaaagatacagggaaactgtctgtttttatgcttaggttcaaccaagtacggacagccatgtagaaatatggttggacaaaaagagtatgacccaattaatgctattaggctgagaggggaagcccagcaaggcctctctgtttagatgcgctttttttttttttttttttttttgagttattatctacatgtttatgatgttttatttttattgttaaaaattttattttaagttctgggatacatttgcagaatgtgcaggtttgttacatagttgtaaatgtgtgctgtggtggtttgctgcacctctcaacccatcacctaggtattaaatcccacatgcattagctatttatcctgatgctctccctcccaccatccctctgacaggccccagtgtgtgttgttcccctccctgtgcccacgtgttctcattgttcagctcctacttataagtgagaatgtgcagtgtttggttttctgtttcttccttgtgggtgtggggcaggaccctctctggaatgcaggtctgtcttatgacctacagtcaaacaaggtaggacagataacttctttaggggtaatttttgtactgaaaaatatgtaaaaggggagaagttagggtaatatttttggttttatggtggctttggggaaaagaggttctagtttctatgaccagcctcaggggagaaggaggggccggagacagcagggcaggaaaaggtcagagtaaaacttttgattctgaggctgcctttggggccttcactttggggtattattttctgagtcccaacagggctaagagataaacttgtaaaacattgacagaatgatgctccaggtatcttaaatggtccaagatgccatttaaagttagattttattatcttaagctcttataagcattacagtttaattacctagatggagagtgctatgcaaaagtctgtggaaaatacagaaatgactaagatacagtcctgtgttgtttaacaatggggatattgtctgagaaatgtgtcattaggtgatttcattatataatatactttcacaaacctacatggtatagcctacgacacacctaggctgtatggtaagcccattcctccttggctacaaatctatacagtatgtgctgaatactgtaagcaattgtaacacaattgcaagtatttgtgtatctaaacatagacaaggtacagttaaaatatggtattgtcatcttgtaagatgaccattgtatatgcagttcatcattgcctgaactatcattgactgtatatccttctccatctagaaattaataatcagttaggaaacaaaatatcataagcatgtactatgttacatgggagcataagcattgtcccaaggcagggactgtgatataataatgtaatattttttggaagtcacagcatcataataattgttatcctcccaatttcatttttgtatatattaaagtactttctaaaaagaactgaaaggtgcatgagtggtattgtcttcaatgctgtcagtccagagagggtggctgtgcaggcagggaaggaaaggtgggaggacagggtatgtggggagagctttattaaaaatgtggtttatagctaagcctaaaagcgttggtagaatttggataggctgatggtggtgtaccctggaacatggacagggtaggcctgggggagacggactcatattgcaaatggtgggagagatgcagggaaagcggggaaaacatggtaattgaagcagatggcaactcatggggttgtgaaattcagaggtccaaaatagggtgaggtgatggttaggtggggcttggtggcagaaaatccagaagcagtcactttccaagatttgaggagccaggaagccagtttgtatccatagatcgcagctcctagccatcagaaaacagctgtcttggaaggagattgacagaaccagagagacactgtcaccaaggtggactctcaggcacagtatatgctgaggcacatgatagagacaaagtgtagaaaagacagcaagaaggccatttttcacattggctgtaaggcgagatttgatcaagaactgagttgactctatgctcaatgtcagaatatagaacgagagtttctcttttaattaatatcaagattagcttagactctgagttaggagtgaatttgcaggaatttacaggctcttcaatggaaaaagaagatatataagaaagctgtgagcactacacacacacatacacatacacagacaaacacatatgtatatacagtagaagatggaatcttttaagaaaatactttaaaatacacaaaaatgaaattaggagaataataattataatgatgtgacttcctaagaatattatattatctctgcataatttgggggtagttggcatttacttctcatcctcttgagttttccacacatgaatttattgtctgtaaattactgctgaaattcttataccattcaagtgccatgatgattttgagaggactttgtaatctatacagtgttttatacactattgtcattttaaaactccataaataacacaaaccagcaaagtcaactcaaagttggctaaaagcaagtgctgtttctgatataattttgattttatttaacttgttctatttatttagcttgtttgattgaatgtgctttacttaactttgtttcctcttagtgctttggacttctaggggtgaatggagctgggaagagcacgactttcaaaatgctgaatggtgaagtttctctaacttcaggacatgctatcatcaggactcccatggggtaagatacagatttcatcatttttgttgcttaaagagataataagcccagagaacccccagcattttccctcagtcccgtggaataaaatttgaaaacatcattttcctccaaatttaccttccaattaccactcctctgatgtggggaaaagtttccaaatatgaataaactgagctcagtacttccagctggagtaaagggccttggaggtcttatcacagagcagccaaaggcagacgtccctgggaggtatcagagtggattggaagtgcccagctcctctctgcagatggaactcaggggagcaggaaatggccaaggggtggttcttctttattctcctctggataaaacttcaaatgttcccatcagcctaagtggccagatggtttccctctttttaccacccagacttcctctttcaggtggtcatgactccttcagggtgggagcagtgaacacattaaaaaccaagaaagcggcctctaggggagtaggcaagatgtttattccccttgctttaacatatgtgaggtccctgggcaccctgcacactcagaggctgcctgaggccagatgacccctgcaggctctgtgggtaacatacactcatgcattcctttatgtcactcttacctgggccctttcactcccatttcacagggcacctgattcttcacctccttctaaactgtgtgcttggttgggaacattcagggcatggtgccttcacgcccctttctgcacctgtgtggtagtgtgtcttcctttttcccctgctctgatcaggactaatgttaatgatgtttctctctactgcaagaagaaatcccctgctctaaacctctctgtgctcaatttgctctttgatttgtgtgctatcaagtttaccctaacagcaaactgggctcaatatcacaaactaaaatcttagacctttaatttcatagccagtttctggtgattctttctccacataccactcctgtgctgtgccttctaatatggatgtcctcgtatcccattcttttttcagcactgtgttacaaggccccaggcatctatctttcttttttcccactacagcaaactcatggtaacttgatgggtagtcaaattcatagctgtctttatgaatttaaacccagcacccaccagccaacaggttgagatgcgacctccagctttctgttcagtttctgatccgcagagatatttatttttaagagaggttatatgttcttgaccctagttttgtagcaatgaatatggcaaataaaaatcgattaaacattgttttgtggatgtagagaaagaactgtaaaggattgtgtctacaatttcccactggaattttaattgactttatgttgcatttataaattaatttggaaagaactaacatttgacaatctctttttttttacaatcacttgctaaaataaatataattcatttgtgaaagtattttaattaatccttgcagtctattagaagagaatgctcttatcagtaattaatgaaacagttttctacactttctctacagtaatgtctcctttttaaattttattttttatttcaataggtttttggggaacaggtggtgtttggttacatgaataagttctttagtggtgatttctgagattttggtgcacctcacccaagcagtgtacacagtacctaattgtgtagtcttttatccctcactcctctcccaacatttctccccaagtccccaaaattcattgtatcattcttgtaattcattgtatcattcttatgcctttgtgtcctaatagcttaacttacaattatagtgagaacataagaatgcttggtttttcattcctgagttacttcacttagaataatagtctccagttccatccaggtggctgccaatgccattatttatttagttcctttttgtggctgagaggtgtttcatggtgtatatatatgtatatatatacacatatacatatatagatgtatatatacacatatatacatatatattctttatccacttgttgattgatgggcatttgagctggtttcaaatttttgcaattgcaaattatgctgctataaacgtgtgcgcaaatatctttttcatataatgactttttttcctttgggtagatacctagtagtgagattgctggatcaaatggtagacctacttttagtactttaaggaatctccacactgttttctatagtggttgtactagtttacattcccaccaacagtgtaaaagtgttccctttttaccacatccatgccaacatctattattttgattttttgattatggccattcttgcaggagtgaagtggtaccacattgtgttttgatttgcatttccctgatcattagtgatgttgagcattttttcatatgcttgttagtcatttgtctatcttcttttgagaattgtctattcatgtccttagcccactttgtgatggtattttttgtttctttcctgctgatttgtttgagttctttgtagattctggatcttagtcttttgtcagatgtatagattgtgaagattttctcccactctgtgggctggctgttaaccctgctgattgcttatttggctgtgcagaagctttttagcttaattaagtcccatctgtttatctttgtttttgttgcatttgctttttggttcttggtcatgcagtctttgcctaagccaatgtttagaggggtttttccgatgttatcttctagaatcattatggtttcaggtcttagatttaagtctttgatccaccttgagttgatgtttgtataaggtgagagatgaggatccagtttcattcttcaacatgtggcttgctaattatccctgcaccatttgttgaatatggtgtcctttcccatctttatgtttttttgtttgctttgtcaaagatcagttggctgtgagtatttggctttatttctgggttattgattctgttccattcgtctatgtgcctatttttatacaagtaccattctgttttggtgactatggccttatagcatagtttgaagttaggtaatgtgatgcctccaggtttgttctttttgcttagcaattgctttggctatgtgggcttctttttggttccatatgaattttaggatttttttttctagttctgtgaagaatgatggtggtattttgatgggaattccactgaaattgtagattgcttttagcagtatggtcattttcacaatattgattctacccatccatgagcatgggatgtgtttccatttgtttgtatcatctatgatttctttcagcagtgttttttacttttccttgtagaggtctttcacctccttgtttaggtatattcctaattttttttttttttttttttttgcggctgttgtaaaagatgttgagctcttgatttgattctccgtttggttgcttttggtgtatagcagagctactgatttgtgtacattaattttgtgtcctgaaaccttgctgaatttatttactagttctaggagttttctggatgagtctttagggttttctacgtatacaatcatatcatcagcaaacagtgacagtctgacttcctctttaccaatttggatgctctttatttttttctcctgtgtgattgctctggctaggacttccagtattatgttgaatagaagtgctgaaagtgggcatccttgtcttgttccaattctcagggggaatgctttcagcttgtccccattcagtataatattgtctatgggtttgtcatagatggcttttaataccttaagttatgtcccttctattcctattttgctgagggttttaatcataaagaatgctggattatgtcaaatgctttttctgcatctattgagatgatcatgtgaattttgtttttaattctgtttatgtggtgtatcacattaattggcttgcatgtgttaaatcaaccctgcatccctggtatgaaacacatttgatcatggtggattatctttttgatatgctttggattcagttagctagtatttttataaggattttttcatctatgttcattagggatattggtgtgttgtgttgtgttctttttttgttatgtcctttcctgattttggtattggggtgacactggcttcatagagtgatttagggaggattccctctttctctatcctgtagaatagtgtcaataggattggtcccaattcttctttgaatgtctgatagaattcagctgtaaattcctctggtactggatttgtttttgttggtaatttttttaattatcatttcaatcttgctgcttgttattggtctattcagagtttctgtttcttcctggtttaatctaggaggattatatatttccaggaatttattcatctccttcaggtttcctaatttatgtgtgtgaaggtgtttatactagaattgaatagtattttttatttctgtagtatcagtaataatatctcttttttcatttgtaattgagcttatttgaatcttctctcttcttttcttggttaatcttgctaatggtctatcaatttgatttgtcatttcagataaccagctttgtgtttcatttatcttttgcattttttttgtttaaatttcatttcattctgctctgatcttcattatttcttttcttctgctgggtatgagtttggtttgtttctctaagtctttgagatgtgactttacgttggctgtttgtgctctttcagatgttttgatgtaggcatttaaggctatgagctttccttttagcattgcctttgctgtatcccagaggttttgacaggttgtgtcactattatcattcagttcaaagaatttttgaatgttaatcttgatttcattgttgacccaatgatcattcaggagtaggttatttaatttctatgtatttgcatggttttgagggttcctgttggagttgatttcccattttattcaactgtggtctgagagagtacttaatataattgtgattttcttaaatttactcagacttgttttgtgtcctatcatatggtctatcttggagaatgttccatgtgctaatgaatagaatgtatattctgtagcacatgaatgttctgtaatcatctgttgagtccatttgttctagggtatagtttaagtccattgtttctttgttgactttctgtcttggtgacctgactagtgcagacagtggagtattaaagtcctccactatcattgtgttgctatctgtctcattttttaggtgtagtagtaattgttttataaatttaggagctccattgttaggtgcatatatgtttaggattgtgatattttcttgttgggctagtccttttgtcattatataatgtccttctttatcttttttttaactgcagttgctttaaagtttgttttgtctgatataaaaattgctactccagcttgcttttggtgtccatttgcatggaatatctctttccacccctttaccttaagcttatgtgtatccttatgtgttagatgagtctcctgaagacagcagaaatttggttgatgaattcttctctattctgccattctgtatcttttaagtggagcatttaagccatttacattcaatgttagtactatttgttgcctgaatgtcttgtttgtttgtctgtttcattgtgttattgttatataggtcctgtgagatttatgctttaaagaggttctattttggtgtattttgaggatttgttttaagatttagagcttgttttagcagttcttgtagagtggggctggtagtggcgaattctctcagcatttgtttgtctgtaaaagactgtatctttccttcattcatgaagcttagatttgctggatacaaaattcttggctgataattgctttgtttaaggaggttaaaaatagaaccctgatcccttctagctttcaggatttcttctgagaaatctgctgttattctgatagcttttcctttataggttacctgatgcttttgcctcatagctcttaagattctttcccttgtctttactttagataacctgataactatgtgcttatttgcatggttttgagggttccttaaaacgtaggtgatgatcttttttcaatgaatttcccaggtgttctttgagcttcttgtatttgaatgtctagatctctagcaaggccagggaagtttttcttgattattccctcatatatgttttccacacttgtagatttcccttcttcctcaggaaaaccaattagtcttaggtttagatgcttaacataatcccaaacttcttggaggctttgttcattttttaaaattcttttttctttgtctttgatgaattgggttaattagaaagtcttgcctttgagctctgaagttcttgcttctgcttttccagttctattgctgagactttccagtgcgtgttgcatttctctaagtgtgccttgatttccagaagttgtgattttaaaaaatttatggtatctattacactggagatttttccttccatgtcctgtattatatttttgatttatgtaagttagagttcacctttccctggctcctccttggttagcttaataattgaccttctaaattatttttctgacaattcagagattttgttttggttttgatccattgctggtgagctgatacgatcttttaggggtgttaaagaattatgttttgtcatattaccggaattgtttttctggtttcctcctcatttgggtagactatgtcagagggaagatctgggactctagctgctgtttagattcttttgtcccacagggtgctcccttcatgtggtgctcttccccttgccctaggaatggggcttcctgagagcccaactgtagtgattgtttttacccttttgtgtttagccacccagcagagctaccaggctccaggatggtattggggagtgtctgcaaagagtcctgtgatgtgatccatcttcaggtctttcagccgtggataccagcacctgctcaggtggaggtagcaggggaatgaagtggactctgaggttccttggttgtatttttgtttagtgtgctggttttgcattggttggcctccagccaggaggtggcgctttcaagagtgtatcggctgcccttgtggaagaaggatcaggtggtgggtggggccatagagttcccaagagattatgtgctttatcttcagctaccagggcaggtagagaaggaccatcagatgggggcagagttaggtgtgtctgagctcagactctcctttggtggggcttgctgtggtggcagtgggggtgggtgtgtggttctcaggccagtggatttatgttcctcaggggattatggctgcctctgctgagtcacacaggttgccagggaagtggggtaagtcggcagtcacaggctttaccccgctgccatacagcctgcagtcctaaagacaggtctcactcccaccgtggccctcccaacagcatcaagtcaatttctgggcagttggtgaccagggctgagaacttgccccagagaactcagccttcctgctgagaaagcaaatggactcatggttttccgatgtctcattgagccagcagcagtgatccagttccttcaaagggtctgtggattctctcagctttcctggtatgttcctagggtaattcttgtagcaaaagttcacgatatgagtcttcacatgcagctgtctgagcaggagctgcaggctagtcctgcctcctttccctctatggtaacatctctgattctaattctccttattgctttccttagaactatcaaaacaatgttaaatggcaatgcattttctcatttaatggtaatatttctatttatgaaatgatggattgaaaattatctacaaattttcatctaatgtagacattattttgttggcaattttataaaaagttcttacaagaatattttaaatttatcactttaaggccaggtgcagtggctcacacttgtaatcccagcattatgggaggccgaggtgggaggatcacctgaggtcagaagttcaagaccagcctggccaacatggtgaaaccccatctctactaaaaatacaaaaattacgtgggcgtggtggtgtgtgcctgtaatcccagctactcaggaggctgaagtgggagaatcacgtcaactctggaggcggaggttgcagtgagccaagatcacaccactgcaccccagcctgggtgacagagtgagactccatctcaaaaaaaaaaaaaattataacttcaacatttataaagttgcatgtattttatagttcttttccttttgacaaatttgttataaataagaggtagttgattatccacctatccttagctttccataataaattttatttttgttagatttttaatatttttgttaaatttcatatgctaatagtctatatagattttatatttattattcataagaaaaattaatttgttgaaaacatcattttcaatttttgctattaactattttgcatttttgtaattttgacaatttgtgtttccttagaaactcattaatttaatttaaaattgcaaattacttacataggattataactatggttctcctaaaatttgtatttccttcctatacctgtgtctgtatatttgtgttttatttctataagttatattttccagattctgacttttatttttaaaaggatgaaatattaatttatttagaaattcaaattatttttgcttttcaaatttatcaaactttgtcattcttcttaatcccccaccatgcttttctcaatctagttttgttgttttatttctaactttttgatttaagtgttttttgtgtttttcatcttaaaataaaaaatcaaattatgaggactaccaatatgctttttgtacagcttttaccttgatcctaaaaatgtaataaatcatagtattgttgttattctctaaatgatgttagaaatacattttcagtgccacaaaggaagtagcactcgaacatgaattttctcagcaaggcaattttacttctatagaaggatgcatctcacggatggagcaatggcgagagcacacctgaacaagggaggggaaggagtttttatccctgacgcaggtagcccctactgctgtgtcattcccctattgattagggttggaccacacagtctaagctaattcctactggctattttaaagagagcagggttacgagccagagtggtgggatgagcagttctggtgggaaagacggttacagaacaaatgactaaatgtgactcaggtcagaacaggtgaccaagggtgactcaggttgcagcaggtgatcaggggtgactcaggacagagcaggtgatcaggagtgactcaggatggagcaggtgaccaggggtgactcaggactgagcagatgaccagggaaacagttgtgaactactgattacaactggtggggaggttgtttactgaaactaggggaaggagatgaggagaacaaggaagttaaactttaaaatgaaggtcatagaactgaacatactgacatactgatactttgaagagaaacttagaactcactgtatttaacaatgacatatatgattttaatatagtatttttatcaaactttagaaggctttttttcagatactcattatcttatttttttctttctttctttccttttttttttttttttttgaggtggagtcttgctctagcacccagcctggagtgcagtggtgcgatctcagctcactgtaacctctgcctcctgagttaaagtgattctcctgcctcagcctcctgagtagctgggattacaggcgcatgccactgcacccgactacattttgtatttttagtagagatggggttttaccatgttggctaggctggtctcgaactgctgacctcaggtgatccacccacctcgacctcccaaagagctgggattacaggtgtgagccatcgcgcccagcctatcttatttcttccttcaatatttttacaaaataattttaaagacttttttgaagtttaatttacatatgaaaaagaacatccaatgacttttcataaaatgaatataattatataatctgtacctacctcaagaaacagaaccagaccaccaacccataaattccatctaatcacatccctgttgaggttaactcttatttgcatcttttttgtttttaatacaacttaatgtattattaaaggcaatcttgtaaacaaaactcaggacaagaagtagaactttggtagctaacttataagtcattctatgtactccattccaaatacaacctcttccatttaaatgattttttttgaattcattacgcaagagtctattcctagacaccatagtttaatcttgcatgtttgtaagatacttgatagggcctttaagttactcaattcacaggtcctttctccattcctttcatttctttacaaactctctgtcgaagaacctgaactgttggacatggtgagttggcctacaaactttgctgactgcatactgatgatggaatttaatatgttcatttgttctgtttcttgcaattgcagctggattcagaggtttagttagacgcaggttcaatcctttggcatgactaaacaggagatgatgttctctttcatcaagaggcacataatgtctgggccaggtgaggtggctcatgcctgtaatcctagcactttgggaggctgtggcgggcgaattgcttgagcccagagtttgagaccggtctgggaaacatggggaaaccctgtctctaccaaaaatacaaaaattagccaatctcataaccttgtgtaaaaataataaatattaaaatataaaactaaaaaataggcacataatagctggtctttagtctttttttttttgcttttagcagttttgatgtttaatgcttaggtgaattcatccattgcaaaatggtcatgttttaacctagtctttttgttttcatttactagtttggataattttgtacagagatgctttaactgtcttttatttggctactcagaggtacagttcatacaggaaaagagacagaatttatttacccagttttcacaataatcaattggttttcagctgtcctcagaaagtgacagattaggttttcatgtatttgtttccttgtatcattctgacttcattctgatagaattagaatgtatcacaagtgtcactttgtgcttagttatctcttttacttcttagaatttcccttttttattctctcgacattctcctctagtcatttcttcatccatatactagaaataataactcaaatgtttaaatgaaggttcaatgctataccacataaaatccaccttgtgcagaaacagacatgctgttgtcatttaactgcaactaacttatatgaagaaaattgcagacctgaaatcaaatctatcttgctccaaatgctacatgctatatctgtttctgtctgtcggcagataatgcagttttacttgggttaatctatgtcaataggtgaaaactcaacattaagagctaattatgtttgagaacagaaagtagagaaaatttattagttgagcaagtgtttgaggttggtatgtgtaaagagagttgtgatactacttactctgaaaggaaatcctgctgtatgggattgaatctctctcaagtgtttccttgatttttctctgcagtcatagaagaagtaagatatttttgttgaatttggaggtaggttttgaaaaaaaaaattctaacttctctatttacaagtacatgtagacaaaagaattttaacttataaagcaaaattaggtttatttcttcatccctggaagactgactctctcctttgtaattctatttcatcatttgtaaaataattggaaaatgaaattcaaataactactcttgaaaagaagaataaatttacatacaaataatggtctgcaagtcccttattatactccatatctgtgtaattagtttaattataactaaatcatgcttgcattaattatattttaaccttgattatttgtaatgttaattgcacattggtattcaaagaattaaataggtaattagcagcacaatggaatttttcactacttagagagttgaaatgtaccttcctgcccatgaagcccatagcttattgctacctaattgaaacacatctactcattcattcaatatattaaggtatttttgtctcttctttgaggttatattatctaaaacagggctcttttactttcctgtttaatttactaatctccatgaatgcacatcttcaaacttgagagtaatacatgtctaaatatatttcaaaattgtccactgtagtttggctcagagcatgtcatgttctcctgatatactgatagttgtctcaggccagaaatcacatgcatttttattattattattttctattctctgtagctcttcttcctactatcgtaactctcaactttttgtcttggcaagttgtcaaggctgcagcatgatagactaggtcccagaggaagtgaagacaaggaagtgaagtaaggaatttaagactaagatttgttttatgaatttgatcaacacagttgagaagcaggcataagaataaataattatttgacttaaaactagcagtctcatatctggaacactaaagtcctgctaaggtagtggcaagattaacaaaaggctctaaaaattggagacaagttttctgatgaaaatcttatgttgtgatatttacttaaaatatgaaaggctgtggcatttttatttggtcagcatagtgttaaaattttggatttggattggcgttggttccagtttgtcacagttgccaccattgcttgttgccttattgatggacaccatcaaacatttacttggactattacatctgaaattattgaaatttgtggctcctgaacaccataaatgttaatctcattagccatgatttactgtgtctctcttattcgccgagtattaagttaggggctttacattctagatcttatttgataattataatgacaaagaggttgttatcctaattttactgacaagaatctaagattcagaaaaattaagtggcttgccggaagtcaaacttctagaacatgatggagctttgaatccaagtttttgaaactctaaatcacatgcagttcctatccaccctttgactattagagaaaacaaagtagtcacaatcaatgagacagaacataaaatattttaaaagggagaagaaaaagagatatatatatacatataaaatatcatgtatataaatatcatatgatatatatcttagttatatctatatatatattttaaaaggaaagttgacagataacagagcaggcacatatttttataataaatattattgggagtatctttccttaaaaaatcagacactcagaaactgggttaaaaaaggtatttttttttttacatgacacaacacaccattacagtgaaattaaaaataatggccattatgcaaatgaaaacaaaacaaaactgtataaatacgttaacatttaaatatataattcaagtaaaggtacatatgaggcaaagacactactaaataaaatacattctttgatgtgaagtcattgcagtcaagaaattctgtatatgaaagacatagaatgataaggtgtaaagcaaagtctgttgggaaaaccagaaagagaatgagaggatacgttggaaggaagagaccttaactctttaattatctaatagttacaaagtgtaatatatttggagaatgagtttcacgtcatcaacacaagaaacaagactgtttatcatacaaacatgacaaatacaactcttcatttttatttatgaagtactagagtaattcctgttaaaataagaaacagaataacatgatcaacattattatttagcattttctggaatttaagttcctgctataagacatagtttaaaaaatagtatgagtatttatactgctaattattatcttttgtgtcatcatacacttaaatacccaagaagatcaattaagaaataatttcaactgaagtggccagaaaaaataataaatacattcaaggctatataatatgaaaaacaattacaatagaaaaaaacacatgcaaggtaatgaataaccttagaaggaaatatggtcaacctatatgttaaaatgtagatgatgttttcagcataaaagaataaataagtaataagataataccatgttgctgaatggaaaagctgaatcatcttactattactctcctctagcaagttttatagatttaatgtaattccaattgatattgcagagaatagagtaggctttacacagaatttctgaagttttaaacacaagaataaatagatgggtctaatcgtgacatttttcaaaaagaataggttgataatggctaaatgacttaagaaatatttcagtgcattatattgactttgtaataaaataatgtctttctaattggattgcttaatcgataagagaaaatcaaaatataaaaaaggtagtatacacattttacattagtgataaaaggaaaagaagttgcaaaattttcctgagattggtattttctatccctcaaagaaaattagaaataaggcaaataaacacattgtttattcaataaggacatttcttttagacattaaattaatgtaaaatttacagtagaaaatacagatatatttaaacatagaaatttaaatttcttctgtaagtcgaaacattaaaattgaaaggctgaaaacaaggatcaaataagacaaagcattaataggtataatatgtaaattactgtatagtgataaggaaaagactacaattacaatacaaataggctagctgggcacggtggctcacgcctgtaatcctagcactttgggaggccgaggcaggcagattgactgaggttaggagttcgagaccagcctggccagcatggtgaaatcctgtctctactaaaaatacaaaaattggctgagcatggtggtgggcacctgtaatcccaactactcgggaagctgaggcaggagaatcgcttgaacccaggagtcggaggttgcagtgagccgagatcgcaccgttgcactccagcctgggcaacagagggagactccatctcaaaaaagtaaaaaataaaaaaaataaaaaataggcataagacttaagcattaaacacaatatgaaagtgaatggttaataaacattttaaaaatagttgccatcattaatataaaaatgcaaaacaaacaacagatacatatatatttttaatcattataaacaactaaaatgtagtgcacaatttcatgaaggtatagtaaagtggacactgttatatgcttatctttggaatataaatcataattttactggagttaagcatggcaatatatataaaaaatacttgggctaataattttccttctgggaaatttgtgcctagggagataacagaaacttggataaaggtttaaatgaaaatatatttattctagtaaataattgagaaggtattgttcctatatatttaacaattacattaattacaaaatgttggtgcaaaatcatttaaaataatattaaatatattaaaatggaagattagcataacttgaaaatgctctcattactagataagaattatctaaaacgattatattagtacctatctgaggtcacaagaaaggagggaaatttccaggtgccataaaagaagaaaccaacaaacctgatgtgatactgtgcaatatatatttttgtcttagacccatttccaagcctacaactcctaaaattcttggaatgtccaaactgatgtaatttttatgctaatgatttatggcgctggcagcctctaggtcacttcaggatggggctggtcaccagaaagaccaaggcaggattacagggttgggacttccagccacacccctcaatctcaggggatgatgagacgctgaaggttaagttgatcacaaatgaccaacgatttattcaaccatgcctctgtaaaagctctgtaaaatcccccaaaactgtgttcagggagtttctggatacctgaacacttgatagttcctggagggtggttcccagagagggatggaagctccataccccttcccacatgctttcccttatacatcttttcatttctatcttttgtaatagtctttgtaataaactggtaaatgcaaataagtgtttccctgagttctgtgagccattctagcaaattaatcaaacccaagaagagggtcataggatccctggccgatcccaaaaggtcagaagctcaggtaaaacaacctgaggcttgtgactggcatctgaaagggagcggtcttggggactgagccctcaacttgtgggatctgattatgtctgcaggcagatagggtcagaatagaactgaactagagaacattcagctggtgtctgctgcagaaatgattgcttgattgttggtggggagaaatccccacacatttggtcacagaagtcttgtgttgattgttgtggtgtgagagcagaggaaaaacagagttttcacactttcattccagagtaattgcttgtgttgccacctaagaaaggggcaaagcatatgtaaatttctgatttggaggcataggttttaatgtccctgatggtgcaagagctatgactgcagctctgcatgtggagaagcattgaactgaaactctgtataaagctaggatcgttgaaaggctgcatccttactgaaggggtaggatctagaaaagaccttctactggcatagaaagataataggaaaacattaatttctgtctaggattagaggtgaaaagaaaaaaatctcccctggaattttgaaaacctgagcttataccctagaactgaaactcctagaattgtgggagtttaaatttgactacctgtgatctgagaaccacaactccccctacccaagaatataacataaacattgacctcagtttgatgatacccatgggcacttttaagaagaaaacacaaatctttgcaaggatggtctcacagctcatatatcattttttttcaagagcccattaaagtggagtgactaaacaaacattacaaaacacacaagacaactatctactatatagataaattaatggctatcacaaaaaggagaattggcacacaaagaatgtaatgtaagagaactacaatcacaaagaaaatgtaagaagtaccatgatatgagagagaatagatttgaaaaaaaaagtactaagattaaaaactgtggctattaaaaagaaaaacaatggttgggttaaaaacaaatgatgtactgctaataaaaaatatgaaaatgaaattatgtgaaatatggaggatagaaagaggtctaacataagtctaattagatttctgaacaaaagaatagagacaatgggagagaggcaccatttgaagaaataataggtgaggattttctagtgttaagactgttgcttccttcaattgaagaaacattacatttattgaatataataaatgagacattcatacttaggcactttgtgttgaaaccaagaattccaaaaacaaactcttaaaagaaacaaggtggcaggtcaccacaaagtaagaaatacacctgcatctgttcacaataatagccactagccacttgtagcatctaaaattaaatgtaaatatgttaaaatcaaatcaaattataatttttttctcagcagccactagcaacatttcaagagtacaagaaccttctgtttcaggcagcacagatacaaaacattttcattgttgcagaaagtttaatttggcagtgatgaattagaccaaagaccaacttcttgacagcaagaatataaacagaatccagtaaaatgaaagaacataatgaatcaaaatgcattaataggtcaatagttgttatatatagacacagaattataggttaagttttattttttcttaatccttcctgtactttccaaatcttgcgctatgatcgtgtgttagattatcagacaattaaataataaacgggatataaactcttaagacaaaagcctttctcttcacatttcaaactagcattttttgagtttgctccattttaatatatgcaactgggataaactgttttttccttaggttttcccgttttttaagtgaccgtatcatagaattcatgtgaacaataactatgaagtgctatgacaccatcaaaattctaagtattatgtatataatacttaaaaatttatgtataaattactgtgcttcatataaaccaatgcactaccaatatatacaaaaagacatggaactcatttattgcttttaaatgtttcatcttcctttagactaatatgaatcacaaattagagtagtttgaatcataacctcaccaactagcaactagttgacaatttaattttctccatttaaaattaaatgacaatttaacaatactaacctaggaaaacaatgaaagaaagtcctctctaattttacatcaaagtgatttttattcttgcagacaccagtttaaaaaaatggtctaactgtgcctctatgtttgtatgtatcaattatctgtctgcatgtacacatgcttgcatgtacatatacacaaaaatgctcatatacagtgtatatttttttcattcatttcattcagtttttaaatttacatcatcatatcaaaatgttttcagaactgctgcacagtcttcacattaatgcctaccttgtattccactggttttctatgccagcatgtactgagtcatttctctattacatagttatattctcatttgaatttcccttccctggaacaaagtatctcttagctgaaaaagtcttattctgtgaaagaaaatgctgcctcttccatgctatgtctaagatatggcagaatgtgcaaactagcagaaagcatctgtatttagccacaagcattgacttcagtcggccccatgtagatctgtattagatgggtttccctgctgcttgctgcctcaggcttccatggggagcacccagaatacagtatgtgcagaggtgttcttaatttcacactgaagatgctcactcctctgcacacatggtccgtgatgtcccaactttacactggtgtaaaaatgatacacatttcagtgagtaccatactttgggtacccatacaatcattcttttcactttcagtacagtatttactaaattacttgagatattcaggactttattatgaaataggttttatgttagatgattttgcctagctgtaggctaatgtaagtgttctgagcacacttaagataggctaggataagtgatgatgcttggtaggttaggtgcaataaatgcatcttcaacttacagtattttaaacttacaataggtttattgggatgtaaccccatcctaagttgagaagcatttgtatttgctacttgttgatgtttacttcctgtttgctaacacactacctgtggtgtggcttctgtcatccacgatgtcttttgtgtcttttcaagaacaacaaggttgatgcatagctagaactgataatatgttctttttagtggaaaatatcttctgtatataacaaactgctaactgctcatacacagcgagtattttcatttgttagttttcactggaaaatattgtttatcctataggaatacatatatttctatattcctatcccgatatgccactataattaaatcatcttgggtacagtctttgtttcattacgcagtggtattagaaaacttctgaaagtcccctggcggagaaatgtccctaagcattttgttaattaagggataatttcactgaagaggaatattggaaggaattgctttctttctcagacatttaaatataaaagccgagttgaagtctttgttaatctagaatctatttttctttctaaggctatgccaacataaaaccatattttctttagttaatgtaatacagtactgggagtgaaggatgataaaaacaccagcatgtaacacattttttttttttttgtccacagattgttaaacgtcaaaagcaacctcacgctatggcttatgtattgagctgtgtgagagttcacatgtcgacttccaatcttcaaattttagttaatatattgtttgagctccctagcgcttcatgggaagtcctcactgggagaccttatctccctttcagctgctctcgttacatagaaactaagccaccatgagcaatgtgcaggttccctcatgccagggtgttttctgcatgccttgcttgcacagcttctatgttccctacatgctccttacacctggggagctctaatcctgtcagtgccaggcacaggtgagtctactgactcacacaggaagggaggattattctcagcttctttctaagattgaaacttgactacatctctattaaaatagagatgggtggtggttgcctggtaaacctatagccagacaactctagcctatttaggagtcattattttttctttactttttttaaaaaaaatttactttaagttccaggatacaagtgcagaatgtgcaggtttgttacttaggtatacatatgccgtggtggtttgctgcacctattaacctgtcatctaggttttaggccttgcatgcattaggtatttgtcctaatgctttccctccccttgccctctacccgccaacaggcccaggtgtgtgttgttcccctccctgtgtccatgtgttctcattgttcaacttccacttatgagtgagaacatgtggtgtttggttttctgttcctttatgagtttgctgaggatgatggcttccagcttcatccatgtccctgcaaaaggacatgatctcgttcttttttatggctgcatagtattccatggagtacatgtaccacattttctttttccagtctatcattgatgggcatttgggttggttccatgtctttgctaccataaatagtgttgcaataaacatacgtgtgcatgtgtctttatagtagaatgatttattttcctttgggtatatacccagtaattggattgctggatcaaatgatatttctggttctagatctttgaggaatcaccacacgtcttccacaatggttgaacaaatttacattcccacaaacagtataaaagcgattttatttctccacagcctcaccagcatgtattgtttcctgacattttaataatcaccattctgactgacgtgagatggtatctcattgtggttttgatttacatttctctaaggatcagtgatgttgagcttctttcatgtttgttggccagttgaatgtcttcttttgagaaatgtctgttcatatcctttgcccactttttgatgggattgtttgtttctttcttgtaaatttgtttaagttccttgaaaattctggatattagacctttgtcaggtgggtagattgcaaaaattttctcccattctttaggttccctgttcagtctgatgctagtttcttttgctgtgcagaagctctttagtttaattaaaccgcatttgtcaattttgaattttgttgccattgcttttggtgttttagtcatgaagtcttcataggcagatgaagcatagctaacatttctgtcctatgcttaccacaaagtagctgaatatttatttttatagaaaattctgcgtttcatatattttcttctttaccaaactctttgaagtctctatttttcttttttttggaaatggagtctcgctctgttgcccaggctggattgcagtggtgcgatgtcagctcattgcaacctctccccaacctgattcaaatgattctcatgtctcagcctccagagtagctgggagtacaggcgcctgccaccatacctggctaatttttgtatttttagtagagacggggtttcatcatgttggccaggctggttttgaactcctggcctcaagtgatccgccccccctcagcctcccaaagtgctgggattacaggcgtgagccaccaagcctggtctctactttcttttttatctttgagtaacaaatctcttaatttatgtgtgtgttgttgtttattcttcttttttcagtggatgatgccactggctgaataatactgtgaatccatctatttatctatctacgtacctacatacctatctatctcatctatctatctttttaatctatccatccgtctgtccatccatccgtccatccatccatccatctgcttggcagacctgcacaggtcatccatgttatgtcacctccccacactatcagtgtgcaccaactgtcatcccaggcagatactgtttttaataattttacagataagactaatagaggccaactgaaaattttttttaccttccagctctttactgagcattctattttagtcatatttctaaatatttcaagaattattttttctctcttgacttatttatgaaaaaaatggcatcctactttttagaaatgcaatatctaaataaatcattttttctttaaatattgatgtatttttcttttaaattagtttatctgcattgtttcagctacctgaattttctggagttttttgtttgtttttgtattgttcatgtcatatatttccttcaaatagctaatgttttgtgattgtctactcctacttaatatgtgagcattaaaatccttaatgaaaacccttggtatatggctagggcttactgactgttcactatagagtgagctatcattttgatagaatttggtgaggcaataaaagtaaaatgtacatttaaacttcatctttaattagatgtctagattaattaaaaccacttttgcattgccactataatcccatgtgattatgttgtattcctttgaatttttcaaaaatttgaatttccagaatcaatagtgaaatatttttgagttacagacacataaatctaaggattattagatctgtcctttttctcttcagtcttgataatgttctttgattttagatttagactgcttttaggttattactttattattttttcttttcaaataaattcgtatgtattgcactcttttttttttttaagatatatgtctgttttaatttgtttctactgaccaccaactttttcattcattataataatgcttaattcccagtttggtaaaattaatcttagttgtgttttatttttgtaacaaaggatgactgcagtgagagattccctgtcctgattccctgactaccagagagtaggtttcagccttcccttctgaaagacaagaatgcacatgccattctaaggtcacacattttctcaccagactctgggcattatcctactgtcttctgacagtcagcatgcaatggagaggtccaaggcagcctcactttgattcttgttcagatatttacatgttttatgttctttcctctgaagttaaccaaaaaaagcaagaaaacaaaacccattaaactccttgtcaaatcatcaaggcttagtagtattttcatttgtccttttagcctttattcatagttttgtttttaatttaagaaaataattttggtttccttgcagtccttactaattttaacctattaacctgttgttctcattctggagggccttaaaaaaaaagttacaattttatctcagacattcctttccttgggttttatgtttctatttcattgaggctgcttcatcttgcattcttctggaaataccagtgtctttccttaatattcagatacatgttttgctgaatcttagagattttgttccttttccactgtttatttttagaggatgttgttttactcatctaagaaaatgtaaactttttattaagttgatgttgatcaacagcaatggacagtagaattctctctgcttactttggtggtggttggatacagaatttggacctacaacataggttgaatagaaatgtataggtcttagttcagtcttggtttttagcaaggttttactttgtacttcctttgtattgtaggagcattgttcctcacctttgttgccttttttttttttagaaaaaaatatgtattgacaaattataattgtatatatttacggggtacaaagtaatgttatgatttaagttgtttaatttttaatatttgttggtacataagggttatatatatttatggggtacatgagatactttgatataggcgtacagtgcataataatcacatcatgacaaatggggtatctgccccctcaaacacttatcctttttgttataacaatccaattatactattagttattttaaaatgtataattaagttattattgactgttatgctataaaatactaggtcttattcattctttacaactacttcttgtacccattaatcatccccacttccctccctacacacccactaccctccccagcctctggtaactatccttctattctctttctccatgaattcaattgttttaatttttagctcccacaaataagtgagaatatatgaagtttgtctttctgtacttggtttatttcacttaacacaatgaccaccagttccatacatgttgcaaataatgggattctcttttatggctgaatagcactccactgtgtatatgtgccacattttctttatctattcatctgctgatggacacttaggttacttccaaatcttacctattgtgaacagtgctgtgataaatgtgggagtgcagatatcccttttacatgctgatttcctttcttttgggtatatacctaggagtgagattgctaggtcctttggtagctctatttttagttttgaggaacttccaaacttttctccatagtgactaccaatttacattcctactaacagtgtatgagggttcccttttctctgcatcctctctagcatttgttgcttgttgcctgtcttttggataaaagccattttaactggggtgagatatctttttgtagttttggtttgcatttctctgatgatgagtgatgttgggaactttttcgtatacctgtttgtcatttgtatgccttcttttgcaaaatgtctattcagattttttgcccatttttaaatcaaattattagatttttcctgtatatctgtttgaacttgttatgtattctggttactaatcccttttcagatggatagtttgcaaatattttctcccatgctttgggctgtctcttcactttgttggttatttcttttccagtgcagaagttttttaacttgatgtgatcccatttgtctgtttttgctttggatcacttgtgttcgtggggtattactcaagaaatttttgcccagaccaatgtcctggagagttttccaaagtaatagtaatagtaactgttcaagtaatagtttcatattttgaggtgttagatttaattctttcattcgtttggttttacctttttatatgatgagaaaataggggtctagtttcattcctctgcatatggatatccagttttcccagaaccatttattgaagaccatcttcttctgaatgtatgttcttgacacctttgtcaaaaatgaatttcctatgggtgtatggatttgtttctgggatttctattctgtcgcattggcctatgtgcctgtttttatgccagtaccatgctgttttggttactatggctctgtagtatattttgaagtcaggtaaagtgattcctctagttttgttctttttgcttaggatagctttgtctattttgggtcttttgtggtttcatataaattttagggttgttttctctatttctgtaagaatgccattggtattttgatagggattgtattgaatctgtagattgttttgggaaatatggatattctaacaatattgattcttccaattcatgaatatggaatatctttccatttttttattccttctttgatttctttcaccaatgttttgccatttttattgtagagatctctcacttctttggttgggttaatttctagatatttaatcttatttgtggttatattaaatgggattactttcttgatttctttttcagattgttcactgttgtcatgtagaaatgctactgatttttgtatgttgattttgtatcttgaaactttaatttgtttatcagttctagtagttttttgtgctagagtgtttagatttttttcaaatataagataatattatctgcagcaaggataatttgagttcttcctttctagtgtggatgccctttattattattatttattattattattattattattatttgattgctctggctagaagttccagtactatgttaaataacagtggtgaaggtgtccttgttgtgttttagatcttagaggaaaggctttcaggttttccctcattcagtgtgatactagctgtgggtctgttgtatatgacttttattatgttaagggatgttccccagttttttgagggtttttaatcataaagggatgttgaatttactgaatactttttcagtatcaattgaaatgattatatggtgtttatccttcattctgttgttatgatgtatcacattgattgatttgtatatgttgaaacatccttacatccctaggataaatttcacttggtcatgatgaatgatctttttaattcattgttgaattcagtttgcttgtatgttgttgaggatttttgcatcaacattcatcagagatattggcacatagttttctttttttgatatattgtctgatgtgggtattaaggtaatactggcctcatagattgagtttggaagtagtctctcctcttctacttttcagaatagtttgagtaggattggtattaatttgttaaacatttggtagaattcagcagtgaaatcattgggtcccaggctttattttttgctgggatattttattatggcttcaatcttgttacttgttattcacatgttcagattttgaatttcttcatggttcaatcttggtaggttgtatgtgtctaggaatttatccatttcctctagattttccatttatgggcatatagtagccactaatgatcctttgaattgctgtggtatcagttgtaatttctcctttttcatctctgattttatttatttaggttttccctctttttttctcagtctggctacaggtttgtcaattttatttatcttttcaaaaaacaaatttttattttattgatcgtttatattattttctttatttcacattcatttatttctgttttaatctttatttattttttaccaattttgggtttggtttgctcttgcttttctagttctttaatatgattattaggttctttatttgacatttttcttcttttttgttgtagccatttatagctataaattttcttcttggtactgcttttgctgtatttcatagattttggtatgttgtgctctcattagcatttaaataaatttttcaatttctttcttaatttctttactaatctactggttatttgtgatcatattgtttaatttccatgtgtctctgtaatttccaaaattcttcttgttcttgatttctagctttattctcttgtggtcagggaagatatttgttattatttcaaagtttttgaatcttttaagatttgttttgtgatctcatgtatgttctttccttgacagtgatctacgtgctgagaaggagaatatatattctgaagctgtggagggaaaggttctgcagtatctgttagatccatttgttctatagtacagattaagtccaatgtttctttgttgattttctgtttataatatctgttcagtgctgcaagtggggcattgaagtccccaggtattgttatattgaggtctatctctctctttatctctcataatatttgctttatatatctgagtgctcctgtgttgggtacataaatatttacaattgttttaccttcttgctgaattgacccttttatcgtgatgtaatgaccttctttgtctcttcttatggattttgtcttgaaatccattttgtctgatataaatatagctactcatgctacattttggtttccatttgcatggaatatagtttttccatccctttattttcagtctatgtgtatttttataggaaaaatgtatttcttgtaggcagcagatcattgagtcttgtacattttttttcatttggccactctgttttttgattggagagttttgtcaacttacactcaatattattgataaaaaaggatttactcctgctatgttattgttttctgtttgttttggcatcttctcatctttcttttattcctttattgaagatgattttctctggttgtatgatttaattttctgctttttattttgttgtttatctgttgtatgttcattgatttgagttaccgtgaagcttgcaaatactattgtataacccactattttaaattgatgacaacttaacagtgattgcataaacaaacaggcaaaaggaaactactaaaaactctaggttttaatcttgtcctccagcttcttaactttttttgtttctctttaagttttttgtactatctatgtcttcaaaagttattgtagttattatttttgattgggttcatcacttagtctttctacttgataagagtagtttacacaccacaattacagtattataatattctgtatttttctgtgtgctcactattaccagtgagctttacactttcagataatttcttattgctcatgaacaaccttttctttcagattgaacaaatgtttttagcatttcttgtaggacaggtctgttattgatgaaatcattcggcttttctttgactgggaaagtctttttttttcccttcatgtttgatagatattttcactggatatactcttgtaggataaaagttttttctatcaacactttaaatatgtcttgccattccctttttgcctgtaaggtttccactgaaagtctgctgccagacatattggagcttcattgtatgttatttgtttcctttctcttgctgcttttagaatcctttttttattcttgacctttgggagtttgattattaaatggctcagagtagtcttcttttggttaaatctgcttggtgttctatttgtttggtgcaaaagtaatcacggtttttgacattaaaagtaattacttttggcaattaaaagtaattaccacaattacatttgcaccaacgtaatataaccttcttgtacttaaatgttgatatccttctctcagtttggtaagttctctgatattatccctttgaataaacttcctgcctctatctctttctcttcctccactttaaggtcaataactcttagatttgccctttcgaggctattttctaaatcttatatgcgtgcttcattcttgtctgttctttgttcttttgcctcctctgactgtatttttaagtagcctgtcttcaagctcatcaattctttcttctgcttgatcaattatactgttaagaggctctgatgcattctttagtatgtcaattgtaccttccccttccttccttccttcctttctccatccctccctccctccctccctcccttcctcccttccttccttcctctctctctccctttcactttctctttccctttctctttctctcttttttctttttctttttttttttttgacagagtctcagtctatcacccaggctggagtgcagtggtgcaatcttggctcactgcctcaccctgtcacccaggttggagtgcaatggcgcaatcttggctcactgcaacctctgcttcccaggttcaagtgactctcctgcctcagcctcccgagtaactgggattacaggtgcacaccaccacgcctggctaatttttgtattttttagtcaagatggggtttcaccatgttgcccaggctggtcttgaactcctgacctcaggtgatctacctgccttggcctcccaaagtgctgggattacagacatgagccactgcacccaggaatcaaatgtatttttcgactctagaattacttcttgattcttttgattttttcaatctctttattaaatttatctgatagaattctgaattccttctctatgttatcttgaatttctttgagtttcctcaaaacggctattttgaattatctatgtgaaaggtcacatatctctgtttctccaggattgatcctgccttagctcatttggtgaggtcatgttttcctggatggccttgatgttcagagatgtttgtcagtgtctggacgttgaagagttaagtatttattttagtgtttacagtctgggcttgtttgtgcccatatttttggggaaggctgggctactgtcatagtggcagcctttttgctttcttctttggccccctctcagctgctaatgtctatctaactacctaacataaccactacctgcctaccacctatgttcactcaaggccctagggctctacaatcagcaggtggagaaaccagccatgtttgtgtcattcccttcagggggtgagttcccccaggccctggctggacccagagaagctgtctgggatccagggattagagtcaagtatcttagaaatctacctggtactctattttgctgcggctaagctggctgtcaaaccacaagtcagaatccttccctccttttcctcccttttgactgtcagaggagcctctctcagtggccaccatcactactggctcacagggagttcttcaaggccaacgctgatgtccctttaaagcccaagaatcagcttgtgataaatgctgccaggcctgtgactcacccttcaaggcagtgggctcccttctggtccaagacaggtccagaaataatgtccaagagcctaggcttggactctgataccctaagagctcactcaggtaccataagcgctccaccccactatggctgagctggtacataagattcaagacaaagtcatctttcctttgccctctgcccttctcaagcagaaagattattttatcatagccactacagctaggaatgtgctggatctctcctgaagccaacacaactcagtctcatccaaggcccatggcatattacctgggtatcactgccagttattcaggactcaaaagttctttcgtcatcgagtgatgagtcctgccacgactggggccttcctttcaaggcagcgggttcccttctggctgaagttattctagaaatgtcatcccggagcaaaggcctagattggaggcctcatgaatttgcctggtgccctatttgattgtggctgagctgttaaaagtcctgtttattttttctctcctctctaacagaaggaaggagtcactttcattgccaccagctatgctgccttgggttgagggaagggtggtgcaagaacttccttagctgaccccactggtgtctccctaggtcacatgccaccctagtccactggctgtaatcccagcctagaattaggatttgcctgggaattttagtccttgtgttctaggctccctttcaagtttacctaggaccctagagccctttagccagagatggtaaggcttgctgaaactcaggttccaactgctgggatggatgactcccctccagctagggctggtccaaatgctacctccatgtgtgggcactgactgagccctgcatgattttgctctctgctgtgacagggcagcatttagttcagtgccaagtcccccagtcactgtgctcttcctcccccaagtgcacagattccctctccacaccatacagctgctgcaggggtatgggggagggatgtaatcagcgatttatgactgtctctcccaccctcttcagtgcctcttttagtgatatgaagttaaaaccaggtactgtaattgctcacctaatttttggttcttatgatggtgctttttttgtgtgtagttagttgttaaaatttggtgtttctgcaggagggacaatcagtagaggcttccattctaccatcttgttccacctctattgtgatttttgatgagaatatggaataactaaattaagctgattagcatacccattacttcaaatattttaacttttgtgtgataagcatattagacggttactttctagcaatattgaaatgtacagtactcagttattagctgtatttagcatgttgtgcaatagatctcaaaataaaatcagatttatttattctatctaattgagcctttgtatgctttgactattatcttctgattctcttcaccattcagtctttggtaatcatgattctactgtctgtttctgtgatttcagttgttttagattccacatgttagtgacaatatgtggtatttgtttttctgtatttgacttatttcccataacataatgttctctaattctgtccatatcatcacaaatgacataatttcttcctttttaagggctgaatagtattccattgtatgtatatgtatatatatgtatgtatgtatgcatatatattttttctttattcattttctttatttatccatcccttgatggacatgcaggttgattccataacttagctattgtgaatagcgctgcaatgaacatgggactacagctaactcttcaacataatgatttcaaatctttcagttaaatacccagaatcagaattgctgggtcaaataatattatatttttagtttttttgagtgatctttatactttctctttcataatgtttatactaatacactttcctatcaatagcatgtaagggttcccttttctccacatcctcaccaacacttgtcttttctctttttgataacagatttaacaaatgtaaagcgatatctcattgtgtttttaatttgcatctccctaatgattagaaatgttgaacatttcttcatgtatctgttagctattcagatgtcttatttttagaaatgtgtttcttgcccattacttaattagattattggttttctttctgagaaagtttgtttgaatttcttatatattttggatattaatagcttatcagatatatggcttacaaatattttctcccaatccatagattgtctcttcactgctgttttctttgatgtgcagtagctttttattttgatataatcccgtttgtctttgtttctattgcttgagtttttggagtcaagtctaaaaaatcattgcccagaccaaagtcatgtagttttttctcctatgtttttttttcctacgaatgttatagatttgggtcttatgtttcaatctgtaatctattttgaattgagttttggatatcgcataagataagtgtccaatttcattcttttgcaggctgtcttttctgaaagctttctgaataagtgtagaacatgaaaacaggccccgtctcataagcagcccccagtgtttgaggagcaaagtgccctgtcttctggttggaaagcttccttcctctgtgagccggggttcagaggacatatgcatatgtatggggggggaggtggatacaaagtttgcctgccttttttttcttcatatattctctctttatgatttgaatccttattatgatctgagctgcagttgtgatagtttttggttgttttagtgccactcttcacttctgtcttgtaactattaagacaccttctaatgttattattatactgcttttttgtgggctgagtttttaattctatgggcattttagggaaatattagaaatgtcattccttaatgacatctaaggttggaagttagagctttggttttgaataataaatccgataagataaagtgtgaatcaccatgggcaaaaactcttcttttcttcagatatctaggcaagggaccatggggaatgaaacaaagagaagagctgaggagttaaagaagcagaaatgacatatgcaaacatagattgggtaccatagaacctaactcttgaccagggccagtgaaaaaaatagaatcaaatataattctgaagtagagatgtttgagtcaggattttctgaagagtgacatgttaataagcaacagagaacatgaaaaaggaaccactgggggactagatgctgtctttacttttagatgttattattttattttttggtgtttgttacatgttcaaaggtacatatgcatcctgaaactgaaaggcataaagttgtgattttgatataatttgttacctgtgaatacggtagatggttgccaaaattatgtagcataaataatataaacatgtggtatcatcctctgtaatgatactaatatgttgtgatttccaaaaagaatgatgatgccttatagctttgagttattacatatatgtatgtgtgtatatatatatatatgtctgtgtatctacatatatatattatgtgtgtatatatatttatatatatgtcttgtgatattgctttagcatttgcatttggcatgatcatttaaaatatttttaaatatgcaatgcatggccatggtataaatatccaggctataaaaaggtacagtcaaggtgtgtcaaagtcactgaaaggtatagttttccccagtcatgcagcatttctcttcacagatttcttgtttagttttgtgtaccttctatgtgtagatttgtgttacagtgagaaggagttgttcttcagcacattctttccaatttctaaataataattggtcattgtttgctcatctgtgaggtcagtttgggttatttatatttcctgaagaaagagagggttaaaggctagggtggaaaagtattgggtacctagtcggagtagggaaatgtgtcattaaggttctcccttgctcctcccatgatgaggtctcagcagagatgatgaaggactcagataaagagataagaatgaagtcacctgggctagaaatgccaatacatgtaagagcatgcctggccaaaggagcctgagaccttgactgggacttctctcagagacttcagtgtgttggctgtgcaccaagtctcatagaggaagggcaactttcccccatgaggcctgtcaggtacagattttgtaatggcctgtggtcaggcctgaaaagttgcataagtctttaattggaagcaagactcctcaaatccccccaccccaatcatgtttaattatatccgtgtatggtctagcttttgttgtttttgtttactgcttgtgtgtgtgtgtgtgtgtgtgtgtgtgtgtgtgtgtgtgtgtgttttgcatggcctcatctttcttcctataatttggaggatttctagcctgtgtttagcttctgtggtttcctctacaaatataactctatataatgcttggtttcctacttctttacagggactatattaactcttcagtataaacaatagcaaagttatttagtatattcctaactccacatgtcatctcctctctttctttttaaatagatctcctttcatctttttccctctagcttttttcttttgggaaagcatcatggcatgagactagaagtgagacttggacccacagccagaggttctgggtgcaacacatctctcagatctaatctagcacattgatttggtccaatgtaactgtcatatatggtcctgaattctgtcccctttaaatctgtaaaataataataacctcaatttatccatgtctttttttttttgaggtaaaatacattagaatctctgaaagacactgacagatttaaagaatggtataaaactgaggcattatcatcttatggctactggttatcaacagcttattaacaaaaaaatgaagctcttttttctgatagctgtagtttcaactttttttttaataataatgattcttagtgtattttgacacataatatggtaaagtaacctgtgctcacataggaatttgtttttaatatcactttaggaaaataaaaatcttagtaagtttaccttcccttgcttaaatatctaaaaatatcagccaggtagagaatagttgtactaacattctcaatctatcaatatcttgtaaatagtaaagttttggtatttctttatataaaaatttcttatataattaaaaagttaaatagattagaaaatacgttagaaaaatttgaaatactaaagtttaaaaacctccctgacaatatctattatggaattaataatgcatttaaaatttttgaatctacatatatttggaaaataatacaaatatgtgtaagctatattacagacaattgttatgtgaattagtggctctcatatttactatccggaatctgtaaaatttaacagtgacttgcttgatctctaacactaactttgtggaagaattagatttggtaaaggagttctaagaaaactggaactgtattgttttctggatagtttttaaaactgaacctgtgtgtgtcataaattaagacaccaaatgaaagaaacattaaatgaaaagtctgagtgactgcggaaacggtgataaacataagccaccatttgttctttaaaaacatgtctttgatatattagtcttttcctccaataaattattaagtgggaagattggcagctgctatgaacagagcatgtgtgtaatttaatgagcttttttttttttttttttgccagtagtttataacattttcttcatgggcaagaacaaaaaaaaaaaatctcaggagtatgaaaatataattgtgtgttaatttttctgttttgaaaagatgtaacttaatcagatttgtgacgtctccctcagccaagcacaaaggaataaaatgaataaaaatcattactgaagtcccgaaatgaatgactgttttctcttatgttgcaattgtagtgatgtttaaataccaatctgaaatacccgagagaacttcaacttgtattagagggttatataggtgtgtatgtgtgtgtgtacctttaaaccggggggataaacttattctacctttcaaagaagataaggccgggcgtggttgctcatgtgtgtaatcccagcacccagactccatctcaaaacaaaacaaaacaaaacaaaaacaaaaacaaagaagaaggtaaaaacatattcctaatccatatgtaagaaacaaatcagcatgagagcatcgtaatctttctaaaacaatgtcaagctgtcatggagtgtatgctccctgaagctgtctttggattcagtttctttggttttggtcacaggctcagggccttctcctaacaaacacatggcccatgtttaagagctaacaagaccaacagacaggagcctgtgacattcctgttaacacacaaaaacaattcagatattcaggatccagtcacttgatgaaagggcaggtggtaaactgggggttaaccttcctataaagtatggccagtggcagtagagaatccagcagtttggaagcaaatgaatttaaaatactatctggaaagcaaatcaaatcaggaccattgagctgttctttcttgactctcattgacctactttcacggtttacagactgctgataatataaaggaaattaaatgcctgcagtgagaaggttcttgatctggcaaagacccctcagagtgctccaaacattttatttaatttccaaaatttcttgatctgttatgtcattaaataaagggggagaaacagctagtcagcatgcatcatgataaaagccacttgaagctcacttttctgtcccacccaggactaaaaaatgtcttgcctttccaagtggtgctgaagcgtaaagcatacagttatgactttcactgctaggttgagataactgaaatgcaagtgcatggaaaccgtaaaatggatgtgagcattttctaataatatcaatatgattgacagtgattttgattaaggagatgttggttagcatctcacagagatagattagaagatttatatagatgagctcacttcttctaggtcagtcagaatgagctctggtttagataataagctcttgccttgctgaaaggctttattatcatatgacctccttttgtatgcaaatctgcacaaggctgtacccacttagtgcttccatctggattataagaagacaccatggaaaatgggtcctgttcacttaaactgagttgtcaggttggtcttcgtagatccttatttgcccccaaaattcacataaagaaatttagctattcacagagcagcaggtatttaagccaataaaatagagcatgggaaatcacagtacagtttgacttaacatgtctttaaaatgctatttgagtactgacctctactgtggtttagcacactctggatcttctccgcaaacattctaccgaactacttatagtgatagacacatcactgcttaataaaatctaaagaattgatagatatgctgtgtgcaaaagttgagtgaggtgattcccactaactgcaaagcaactgcaaccattttaattgtacggcacacagaagataccctgctctgaaagtggaagtaaaggttcttcatttgttttcattatgaagtcatgcccttagtttaaaaatataatctaagtaattaaaaattaggcagctgtcattgaactggatgacgggttgctttgaaggcagaaagaccttttccattgttgaatccctgtgttcgcagagtgctgtatttcctgttttgaagtagaaagatactgagtagaaaaaaatgagtatgggccttgggcagtgcagaggctgcaagggtgctggggtcattggacaatgcaaagaatatctgaatatgtattccatatctttatatgttttagaacatttaaaatatatattatatggctttacattgttagggagctcattgagattggggagtagttggtaggagaccatccaaacacattctatcagaacttatataaaaccttttttagacatgaacatttgtgctaggtgattaattaatgtgtggagattaccaacaaattttaaaatatcaacttaaacattgagtatataatactcataaatcataaatatatgggttgatgaacttttatagtattagcatacatgtaactatcatcaggagagagacctttggcagacccccaagaaactcctttcatgaccctatctaaaccaaagataaacactgttctggcttttattagcataggttagttttacttgtttgtgaattttatataaatgagatcatacagtttatatttttacatgagcgattttttcctataaaatcatatttgtaaaatgcttccatattgtcacatgttgcaatagttttattgtcattaataatgacagatatttgttaggaacaatccccaatacgtatatgaatgaaattgcctccatagagcatgtgtgtgtttagcttttgtaaatactggtagtgttttggttaactaagacataattcacatactatcaaacttataattttttaaatgcaacaattcagtgatttttaccatattcataaagccatatgatgatttccactaactctagaacactttcattactttgaaaagaaaccctataccaattaacaatcattctccattgcgtccccccattgtcaaccattaatttactttctatctccatggatttgagtatcctggaaattccatataaataggttcatacaataacttccttttatctcaaattcttttcctgttttatcataaaagggtattgaattttgtcaaattctttttctgagtttaatgagatgtgtggtttttgcactttattccattaacatggtatagatgattggtagaatcaacaaataattaattttatatattaaactaactttgcattcctggaataaattacacttgagcatagtgcctacttctctttatatgggctggatttgatttacttgtattctgttgaggatttttaaacatctatttataagaaataatgttatatagttttctgtcatgtctttagttgtggtatcagggtgatactgaccttatgtaattagcttgggaattttttttctcttctactttttgaaatagtctagaagcattagtattaatccatttttaaatatttggtagaactcaccagtgaaaccatttggtagtgggcttttatttatgaaaaggttttttggcattgtttttattgtttttattattattattactaattcagtatctttatttgtggatctgtttagattttctttttctcatttggtcactttcagtattttctgtctttctaggaatttgtccgtgttatctaaatttcttaggattttggcatacgaatatttagactattaaaaaattttccatttctttaagattggtagaaatattttatttcttattttagtaattttaatattcttgttcccttttgttggtcattgtagctatgagtttgtagatttgattgaccttaaagaatcaagatttgattatgattattttctttattatttcttccctattttatttatttctgctcaaatcattatttttttattctgttttctttaggtttagtttgctttagtttttctaatttcttaatgtaaatggctaggttattgttctgacatctacctttttaaaaaataatacagatattacagctgtatcttctctttatgtacctttttagctgaataccatgttttgatatgttgtgtttttgttttcattcatctcaaagtattttttcattttccttttgatttcttctttgacccattggttatgaaatagtatgttgtttaatttctacacatttggaatttcccaaagattgcttctgtattgatttttaattttagtccattgtagtcaaagaacatactttgtatgatttcagtccttttcacttactgagtttttttgtttgcttgtttgtttgtttgttttttgatggagtgttgctctttcacccaggctggagtgcagtggcatgatctcggctcattgcaacccccacctctcacgttctagtgattctcctgcctcagccttccaagtagctgggaatacaggcatctgccaccatggccagctaatttttgcatttttggtagagagtgtttttcatcatatcgggcaggctggtcttgaactcctaacctaaaatggtctgctcaccttggtctcccaaagtgctagaattacaggcttgcgctactgcacccagctaataagtctttttatttgtttgtttgtttttttaatagccaaacacttgttctattctggagaattgcttctatatacatttgagaagaatgttcagtctgctctttttggatggagagttctaagtctctatagtctcttaggtctagttatcttgttgtattgttccaatctcctatatttttgttaatcttctagcatagttattctattaaatattgaatatagtgtattgaacttgttctattgttgaattgtctatttctccctttaatgctgtcagcatttgctttgtgtgttgtgtggctctgttcttaatttcatgtttttatgattagtctgtcttcctaaggaattgacccttctattgttataagatgtttttctttgtttttagtaacaatattttcttcaagtctattttgttatatattagtagagtcacctcagctctcttttggatactgatttcattgtatatctttttgcatcctctttttttttttttttttttttttgagatggagtctcactctgtcgcccaggctggagtgcagtggcgcaatcttggctcactgcaagctctgcctcccaggtttacaccattctcctgcctcagcctcccaagtagctgggactacaggcgcctgccaccacgcctggccaattttttgttttttagtagagacggggtttcaccatgttagccagggtggtcttgatctcctcacctcgtgatccacccgcctcggcctcccaaagtgctggtattacaggtgtgagccaccgcacccagctgcatccttttactttcaaactatttgtgactttgattctaaagtgtatattttatagacagcatacagttggataattaaaaaaaaatccagtctgccaatctatgaatttgttaaatggtagaattaattgataattatgtggtaattacattaaatgtaaatgagctaaataatctaattattgagatggtaaaattggtttccaccattttactatttgttttctatatttcctctatatttttcattcctctgttcttctattactgccatcttttgtgctaaataagtattttctaacataccactttaagtccttattgtgtttttttgctatatatatttttgagttattttcttagcagttttcctggggattgcaactaacatcttgagttaaaattctctaatttagattaataccaacttaatttcaatagtttataaaattgtgtttctacatagctcctctcccatttatgctattattattacaaattacatttttagagattgtgtgctcatcagcattgatttttaaattattctattatggaaatgcatttaactaaaacagaaaaaggaattacaagaaacacgtacatttatcttgtcatttatatttctttatatggtaatcttaaccagtgctttttgttttatttcattatgtggattcatgttactgttagtacttttcatttcagcttaaagacttcatttagtaattttgaggcagttccactgtcaacaaactctctcagtttttgttgagctgtgaatatcttaatctctcattaaattttaaaagatagtcatttcttctttatttcttctttactgtagaattctaggctagctttttttttttcttttaaccttttgacactttgtgtatgccatcctattgtgttctggcctctgtgatgtctgttaagaaagcagctattaaccttcctggagattctttttacactatgagtcacttctctcattgccatcatgattctccctttgtctgaagtctttgacagtttgattatgatttgtctaggtatagattattttgtatatattatacacataaggatctcattcctgaatatatacaacattattattttctttcaatctttataactttctttttcttgccttattgcactggccagcactggcattataatgttgaatagaagaggtggtaatggggaccttacttttgtttttgatatgaaagggaaaactttaaatattttatgattaacataggctgggtgcagtggctcatgtctgtaatcccagcactgtgggaggccgaggtggatggatcacttaaggttaggagttcaacagcagcctgcccaacgtggcaaaaccccatctctactaaaaataccaaaaaattagctgggcctggtggcacacgcatgtaatcccagctacttgggaggctgaggcatgagaatcatttgaatcctggaggcagaatttgcagtgagccgagaccgtgccaatgcattccagcctgggtgatggagtgaaactttgtctcaaataaaataaaatacatattttattattaacagaaatatatagcttttatggacttggcatacattttaaaatcagattaagaaagttcttttatattttcctttctagctcaatttttgacttttatttatttatttttataaagaatatatttagagacagggtcttgctctgtcacccaggctggagtacagcagcatgatcatagctcaccacagcctcaaacatctgggctcacataatctttctgcttcagccttctagtaggtgggactacatgcccagctatttttataagcaataattttaacattttactattttttctcaccttttctttatactcttagtatattatgtgacattaaataatttttaaattttatttaaaaaatattgaattcatggataaagttgacttggtcaaaatttaataccccttttatatatcacttgatttaattgggtaatagttactaaaattttgtggtgattattatatgaaattatcttgtgaattttacttattgtaacacatttgccaggtttaattgtcaaggaataatggcctcagtaagtaacttgaaaattgtttccagcctgttttccagaatagtgtatgatccatgtaatttttacatagatgtttcaaagaatgccctaatgaaagcatttgggtctaaatttatcaaaacaattttaattaatgattcaatttcgttttacatgtagaaatttttaggctttctatttcttccttttcttggtttattatgttttaagggatttttctattccatctaaattattccatttctatgcagaaatttggtgcataatatactaaaattttatttttaatatctatcttaagtgatgttagtattcctgatactggtattttgtatcaaattatattaatgtttctattcattactatgtttaaagtactctgttactgtcttaattttgcttattataactttccagttataaaatttttatttgattttttaaacagatttcaattttctagtataattcacctctttttcctcttttttgttcatttattaattaaactatgttaaagtctatgtctgataactccaatatctatatcacttgtgggtttatttttattttatttgttttttatcttatttatttatttttttaagtggtattcctggtgtattcattttctaggactactgtaaaaatataccactgtctgggtgcagtggctcatgcttgtaatcccagtgctctgggaggttaagatgggaggatcatttgaggctaggagtttgagaccagcctgggcaacatagcgagactccatctccacaaaacagaaacaaaacaaaacaaaacaacaacagcaacaacaaaacatttaattagccaggcctgatggtgcatatatgtagtctgagctacttgggaggctgaggtgggaggattgctggagcccaggagttcgaggctgcagtaagctatgattgtaccactgcactccaagctcagctacagagtgagactccatctcaaagcaacaacaacaagaacaacaacagaacacaaacttagtggcttaaaccaggaaaatttattctctcatggttctagaggcttgaactccgagatcaagctgttgccattagttccttctgattgctgtggggaagggatctgctacagccctgtctccttggcttataaaggaccatcttctctctgtgtgtttatatagtcttccctctatatatgtgtctgtgtccacattttcctttttttaaggacatcagtcataccagattaaagcccaccatagtagcctcatttggatttgattttctctgtgacattttatcttcaaataaggtcatattccaaggcatggggagttaggaccccaatattattattattattactattattttggatgggacacgattcaacccataacaactgataaattttgattaaatgaaaatatttagagtctctggatgattctgttttacttcaaagagaattctctttagctttgatatggaattagaatagataaaattatctcagaaaatgggatgatcttactaaatacgttttttaaagggcttgtctatttttacatttccggaggcttcactgttcaatggccctgactgaaagccacgttcatttgccagagtcccaacacctgaatgtctgcttaatgacagtttctgttatcccagctggttattccaggtttgttataaatttgataggtttagttactttttagattcttagatttgtgtcttgatttccctcttcaattatagacctgcattactcatacattaatgaacatctcaagcatgagacacctagagttacagggtttttcttactttcttccccctgggatattggcctctcaagtcctgtctgctctggtagccctgaatctcaatttttatctcttccaaagactaataacagctttgcttagctcctctgccttttagccatcactttctccacaacatcattacttcttcttcctcattttatatgtgtgactaatatttcgaggaaaaacaaacaaaacacatgtctcctctcagtgagtttcttctttttgggatttgaatctttaattcctagtctttaaatagatttttctgcattttatccagctgttccattgttttatgggctattgaaaacaactcccattttagcatcaattttgataataaagcaaaaggataatatagcacatggatggtatatttgaagccacaggtaatatatacattaacatttataaatattcccctatccagaaaatacttgaaacttgagtttccagtagacattttttttttgcataacacatgtaaacattttatggtacatacttagacttaacatttattcattgtctatctgaactataaacttaagtggatattttgtatttttttctggcaatcttgctctctttagaagaatgcataaacaataatacaccagaataattatggtacaaaagctgattggagcactatggaaagattctaactaaaaattatacatggatatttttattatttaaatataagggaatggttttttaaaagttgatactctaaagacttaaaggttaaaattttatgacataagtgtggaaactttcatgataaatgtgctagctgaatttgaaagataggagaatatggatgtaatagaaactaatgtaaaggaaattaagtacccagtagatcttaaattctgttttctcttatatttatcacatacaacagaattaaaagtgcggaatattaaattagcgctgccagtgataaacttgagaaattgttctactgtgtagattagaagccattgacatgatgagtaagagaatggtatacaatgtagaggatggagagatacatttaaaatttatagcttttcctgtgggtcagagatgtggaacatgaaaaaatgaaacaaaaactctactgaaaaaggtactgagttgtggcttttggtacaacatttaaagagcttgcaagttgtcactttcattttcacaacaggaaaataccttaaaaactaaaaattatcaactcttcttagatccctcagagatttgaggtcagaaagcaaactgctaccccagtactagagagacagtcaggggaccccctacacccatgggttcatatccatggattcaactaactgtgccacaaaatattcagaaaaaaagggatgattctgccggtactgaacatgtacagacttttcctgttgttagtattccctaaaaaatacagcataaccaccgtttatatagcatttacattgcattaggtattataagtcatctagaaatgatttaaagtatttgggaagatgtatgtaggttataagcaaattctacagtattttatataaaggacttgagcatctgtggatttttagtatccaaagggagtcctagacccaccccccatggatatagaaaaacgactgtactagaaggaagcccaggactgtgaatcaggagacccagaagcagaagtcaccatatgaggccaggatcagtaggaacacatccgctataatcaaaaagtgatgtaggctcagtgtggactaacttgaaagtagccttgggggctcctcactgatgagtattacctacaggaaccctaccagattctccatgtgaagacaggggaaaaatcctttcgtgctttcagcaggagttaattatatagaagtatgcccagacctctgtaagcattagaaagaccagcccaaaggggaaactgcttttccagagcctaactgacctgggaaaagggaaatgcccagctcaggctctagaagactgagacatgattgtgggaatatagaactcttcccctcaaccaactcctcaccaccacatcagtggtgctcctgtgtaataaccagggactaagagaactacaagcctcagactctatttaagatggaatctctaggcaaacccaaagacaactgggtataaacagaaggacactagaactaacaccactgagacagccaccagtaagcacaatataacttctagtcagataaactcaaacctcacactaaaagcccaaataacagcttaacaataaagaaatagacatcatccaaactatgctgtcaaaccacaatggaattaaactagaaataaaaaatagaaggatagctttagaaatccccaaatatttggacattaaataacctatttctgggtaacacacacgttaaaggaatcagaaaagaaattacaaaaattaagcttcaatgaaaatgaaatttaaacctatcacagtttgtggaatacagcaaaagttgtgcttaaaggaaaattcatggaatttgatgcatctgttagaaaagattagagacctaaaatagataatctaagcttatatgttactaaactagagggagaggagcaaattaaattgaaagtaagtagaagaaaagaaatgataaaaattagtggagaaatcaataaaattataaaaaggaaaataataaagaaaaatcaatgaaactaaaagctgaaatcaatgaattaaaagatgaaataaataaaattgataaactcctagtgagattatccatgaaaaaaagaaaatacaaattactaatatcaaaaaccaaagatgttatccttactactctcatgaacattaaaatattaataaggaaatattttgagcaactctatgcccacatctttgataacttacttgaaatgggccaattccctgaagacacaatttacccaaacacatacaaggagaaatagacaatccaaataggtatatatcattgaaagaaattgaatcaataactaatgaccataaaagcaaaagcactagacttaggtgatctcactggtgaattctaccatttaagaaagaaatgatatcaatttactgcaatgtcttttagaaaatagatacagaacaattatggttaactgtttttatgaggccagcattatcataatactgaaaccagacaagggcattacaagaaaggaaaactatagcctagtatctcttatgaatatacatgcaaaaattttcaacaaagtatcaaattgagtctaacaatgtacgaaaagaattatatactatgacaaagaaggacttattccagataggcaaggttcgttcaatttttgaaaatcaattaatataatccattacaacaatagaataaaaggaaaagatggtttgatcctattaacagatgcataacaacatttttcacaaaagccaacacttattcatgatactaactctcagcaaactaggaacagaaaggacattcctcaacttgataaagaacactgtaataaaccttcaagtgatatactaaatcatgagaagctagctacctttctcctaagtttgggaacaagatgtcctctctctccattcttacctcaatactctgccagcaagcagtcctacgtaatgcaataagagcagaaaagggagttaaaatcacacagattgtgaaggaataaataaaactgttattgcttatagatgacatgattatatatgtagaaactcccaaagaattgtcaaaaaaatactcctagaactaatagccatttatatcaaggtttcaggatacaacgttaatatagaaaagtcatgtttccctatatatctacaatgaataattggaatttgaaattttaaaaacatatcatttacattaacaatccccaaaatgaaatacttagctataaatctaacaaattatgtgaggaaaactacaaaatcctaatgaaataaatagaaaaagctctaaataaatagatattccatgttttggggtagaaaaacttaacatcaacaagatattggttcttcccaacctgaatgttaggtttaacacaaccccaatcaaaatcccagtgttactttgtggatattaacaaactgattttcaagtttatgtggaaagacaaaagatccatgataggcaacacagtatggaagaacaaagtctgaagactgacattacctgactttaagatttactataaaagcacagtaattcccagagatagccccacatcaatacagtcaactgatatatgacaaaagaacaaaggcaaccatgtgggcaaataatcatctttgcaacaaatggtgccagaacaaatggacatccacatgccagacaatgaatctgggcacttaacttatacctgtgacaaaaattaactccaagtggatctatgacctgattgtaaaatacaaattataaaagttctagaaaataacataggataaaatctaggtgaccttggatgtgacaatgcctttttagagacaatatcaaaagcatgatccataaaagaaaatgttggtaagtttgacttcattaaagtacatttctgctcctgcaaaagacactgttaagacattaaaaagtcaatccatagactgggaaaaaattttgcagacccatgtctcataaaagacttgtatatgaaatacataaagaatccttaaaattaaacaataagaaaacacagagttaaaacatgggtgaaagatatgaacagatgtatcaccaaagaagacagatgcaaataagttcataagatgctcaacatcatatgtcattggaaaattgcaaataaaagcaacaatgcaatgcatctatatagctaatagaatgagtaaaatacaaaacactgacaataccaaatgttgacaacagtgtagagcaataggaactctcatttgctgctgatgggaattcaaaatggtacaaccactttggcagacagtttggcagaatcttataaaactaaatatagtcttcccacctgattcagcaatacatattaataaaaaaacagtttgattatgtatgtagacacaggagtttcacacaaaaaataagactcaaggagctgcccagatgattgaggcttatgtaccatataaggctaaacaaagcaaaagggatttggggattctgggcaggggaggccagctatgggaaggtgaggggaggaaatgtatggtggactagggttgtctcattatgcagataagagtctctccagttcagagttttctgggaaagtagctctctttctggtagggagacatctttacaaatgaaaatttcctttgtaaatgtgaatttccttttcaaaagaagacatttatactgaatttttaggcagttaaggagagataaagagcttttcctttgtcctctggttctcagttgcctttagctcaaaataatccatatgccaaagaggcctattttggggtgacttcttgtattcttcacgtctcatgaaatgaacctattattgtgaaatgaactaattgttttaaataaactgcagtggacttgttattgatgagccacattttaaaaatgggttggtgccagtttgggaaactgctgttctcagcctgtgctgcttctctctgcagagacgccgtggacctgtcttctgctggcacggcaggcgtgctcattggctactgtccccagcaggatgccctggacgagcttctgactggttgggaacatctctattattactgtagcttacgcgggattccaaggcagtgcatccctgaggtaaatctccctggggtcttctagataaagggacccattgaggaatgcttggtgaccacctctggctccaaggcagctctctcaccctatgaggagaaggaactgtagtatcagataaacttacctgcaagagattttctaatatgattatactgaagaaaacattaaatatatttcccttattttacattatatatttaaaaggtatctgtgtgaggcagtcatgtggtcggagttaaagcataaatacatcatttataactttgtatcccccttgctcttttcttcctctctaaatgccttttacatttattgaactacaaacttgtattcaggaagaaatatcacaaactctgtattttcagggcttgtgaaagtgtgggcacaaattatgtgtggaatctgggggactgctggaaggaatgacttcctgatgagtgggcggacagattcctcctgccaggggattccttctgccaggggattcctttctgggtggtcttaggggaatgaaggagtggcagaaactgagacccccacctccatcactgcctgtgacaggagagaggcaggtggagcagtgagagagcaaaagacagctgccacttcttctgtgtgagtagaggtcagcgaagcagagcggacagccttgattgacagctcaggatgttgtaccgtgagccaccaaaattgcagttacttaagcacatttttaccttttctgcacctcattatagaaagtctggggtgcgtgctcctcagatttctggattctgaactagaagcagaaataagtggcttatattatgcgtttgcaattagattctgcgggagagggaaaattctaggactcacaggagacaaaactaatagccttcgccttcactggtccatgaacgttcattctctgttctgtttttataatgcttcagcatttgtttcttatttatgctttctaactttaagtgaaactaaacagaatgtctgcacctcattgtaaggactctggccccttttcccatctcccgtcttaataaagcaaagataactgaccaccccacagagacctgctggttgtagttaaacagttattggcatccgtggctaattgttggatcaatttttaatcggtgtttatctctgtcagctcctctttgttagtttttgatgaaagaggcgggtgcttggcaaaggctttaagctggcacttttgtttttcgagggaaacatgcttatgaaaaagctctcgttaatgtaggtcggtgctttctgtcattcagggcaattgtgtcttgatattcatctgtcttacaactttgtttttctgaattgttctaccaataaaagttatttaaatggtaaccaattaggaactgccttcatttcctttataaaactgtaactgattttgcagacagtattgctacttgctcttgtttctaagatgtctgcacacttttgcatctgtttccaaaggagttagctccttttctggaaacaaattttcttttctatatattttgggaatatttaagttatagaacaggcatatccattttgaggtgcttatcacaagatgtccagaaagaattattataaaataatggaaaataaagttttatctttcagtatttattccacatcaggtactgttctaagtattttacagcaaccatatgaagtagatgcttattcccattttacaaactgagaaattagacacagtttaattgagacacagagacacaggaaaactgagacaccagagaaattaggccacttgcccatgttcacatggctagtatttggcaaggttttactttgaaaccatataaaccagctccagggtacaagttcttgactaagacattactctgacacttagtttattcaggctgttagttgtataagatggaatttctggtggtattaacagttcagtcttatttttataaccctgggatggccaaagaagtggaaactgtgtggggttagtgcatgacttctctaacatggggctcctcctgctgcctggctttccattggtctggagttggactcaacatgtgtgcctcacctccaggctttcagaactcatagatatgggggtaatctttagacacatctgctgctcaccttagttgttttcttcaggctgccatctattttcattgtaacatggagagccaccattgtaagctctatgattctagtgcaagaccctctgtgcttgcggggaggctcctttgttcagccttacagtcccctctcctccctcccggggaccctcagagcccatgccatggctgagccagtccacctgtgctccacttgctggtcatttctaagtatggtcaaattgctcacttcctcaacctttcaaaagtttgatgaggtaagaataagatgccacttcataaagcttgaacttaggtttgacaagttaacaatgatttccaaatttcccatgatttacactgcacaaaactgtgcagtgtacatatttgagcctcaatttaattaaccttgtaaagcatgttatattaagttatatcacttggttattaccaaatgatgcaagagatgagggctacatagtctgggatgctagagaaaatgtgtcagagttcatcatgctaggtagtttcaatgttagtgtcataccataacaaacaaccagtacttctaaatgggaagagatttggcaaattctgtgttttagttttccctggtatagaagaggtatggcccctcatcatcttagttttgttaatacctgcacattcctaccagggactgtccctactgtgtcttgcttccccttatcttctgtaaagacatgacttttatatttaagttttcttccattcacacagtcagtttagctagaaggagctagaatttataagatagtaggaatggggacaggaggtcatcttcagaggaagggccaggataaacatttccatctgaaatccttggttccctttccctactttacgactcattttggtctttaatctcacagaaatgttgacctggccattatgtgtgctagtggaaacactttggctttggagtctgatagatgtatgtgtgaatctcagggcaatttattttggctccagtgatgtttatggaagtcctactatgtgccaaacatgaataaacactggggatttccatcccagtgcatatcccattgagattcatcccaaaaccaatgcatccgcaaacgaaagcatcccaaaacaaatgcatcccagtaacttgcctgaagtatggtacaatttctagagcttcatgagagaaaaataccaaacctcagagagagattctgtgaacttttgacattttgggattttaggcagtattttgccaactgagattgctaaggcattgcttttgccattactttgacagtattgctgagtgcagaaaagactacagcaaaatacttcttattaggctattttcagttattttctgacaacatgacattcagaaaacattggatcaaactaatacatttgttcctgtatactctggaatctttcctatggttaaccaatccagaatttgcaggctgcaatatttaaccttttgtgaaattgggaaaacatgacatatgtttcctaacttcataaaaatatgcaataataatttggcaagtttattcaaaatgtaacttgcattctcaggtgcatttctccagaaccaggtacatatattattatttttatttcatttgtcagtttatcagttttcttttatgtatggctaatctttgaataacatggatgagagtaactaaacatttctttctaatacatgcacacatacacacattttcattctctttttcttgtaatatttatagatctaaaaataaccaaaacaatcattatcacaatttgtcatttttgccagcctcaccactgttagtacagcaggtccccaaataacattgtttagttcaacattgtttcattacaatgatgagaaaagtaaaattgattttctgccaggaccactgtcggagaggagtttgcacgctctctccatggctgcatacattttctccaggtacacttgttttctgtcatgtcccaaagctgtgtacattagtttctttggtgtgtctatattgagcccatgtgggtgagtatatgtgggcgtgtgagtgtaccctcgatggaatggcatgctgtccagggctggttcctgccttgtgcactgagcttccaggatgggctctgaccaccctcaaccctgaactggaataattgggtaaatcatgtttttgttaatctttcacaaatatatgtgtagctcacatttatttcagtgtttgctattagaagtttttttttatttagaagtttggagatgtttttgtgaccagacatatgacataggaacttttatttctaccaatcagcttatggtaaaattggtttcattaaatgttgattcggttaaagcggtctccaagaacatatagatgacattaagtaaggacttttttccgacagataaagctttctaacagggtctatcatgctcttagttttcttctcttttatggggacatctgcctccttttccaggaagcctccctggtttccttccttcatctctcatatgagtgtttatctagcactgatttacacttcttggccattcttctgtgagaaaaatttggacgaagctacatgactacttctgctatctctttaattcctgaaatgccaggcatttatatttcttcatttataagacccttcctttaatatttgtgtttgtttgcttgtgatgaataaaacgttttgttttgatattttaaaattcacttaagtgaatttttattcaacttgtgataattaaaatagttgttctgaatggagccaggaaaaaggatgattcatataaaacattctggggaaaatgactttactttcaataagaccaactactggccttgagaagattttcttaggcagatagcaggagattaaatatttcatctttatatatcttttaggccttgaaatctgcatttcctagaattatactattttaccataagaccagtccttgagcctcttcattcatttgcaacatattttgaagttgcacaagtaaagccatataataatttctgttgaaagattttactggggggcataatgattatcctaatatttgtagaggttcttaatgcttcattatcattattgttattatcctaacttttatgtacttgtcaaaaagagtatacacattagtttatatttattcagttatttgggatgcacaattattaaccaatctttttagtcctatagaatttttccctcttctcctaaatttgaattaaaatatgatcttggtcaatttggctatatgattatatctaaaaaatgaatctatattaatacttctatggtcataagagttaaataaaattgtttggaaaatttttaaattatgctaagttggaaacaaaaaaattgcttaccttggaccccaggaagaattaatccagcataggagatagaactggaaacagaaaatatagtgtggtacaaattacagtgggaaatgctaaataaaagtgttctatagacacatataatacacagaagaggtgacacatatatcacacagaagaagtgacaattattttttctgatgagagatatgggctgggccttctaggatgtgggacaagctggcagggtggaaggcagggaagaagaaagaagctgtgaaccgcaggctcttgggtacagtctgaactctcctgtggctggaggggtgaggtttgacaaatgctgccaccatccttgggtcttggcaaagtggttttcagcagttgcaaataagaaatatttcccattctcctccccatctctagttactttataaaccaaactctgagtttgcaaacattaacagtggcttctcaatgtcaaagggatatttctttccttgtgttaatattgaaaattccctccagccataaaaatgaacaaaatcacatcctttgcagcagcatggatgcagctggaggcatcatcctaagcaaattaacacaggaacacaaaaccaaataccgtgtgttctcgtttataggggggagcttaacattgggtacacatgggcacaaacatggcagcagtagacacgtgggaatccaaaagtgcggagggagggcgtgtgacaaggggtgaagaactacctgttgggttccatgctcactacttgggtgggatcattagaagcccaaacctcagtgtcacacaatatacccatgtagcaaacctgcacatagactccctgaatctaaaataataaagaaaattttctgcttcggttgtcttctccctttaagttttgacaccgctattagtttcattcccatttgtttccttctcagttttctttttggcatacccttctctgctcacctcaacatgcttatttatctggacccccaaccttgagtgtgtttcttgcccacccttctccctgaactctagatgtgattattctgaccatcacttagatgtctccagctgcagaaaactcccacctgttcactctcaattactgcctgtatggtaaagggggatgtttcaggagatgtacttgattgtatgtgtgaaggtcggcagggttagtgggaggtagaagcaggaatgaggactgagaccagctgtctggtgggcactttggtgaatgctggtgtgcacatggacatgcctctcttccaggttgctggagacctcatcaggcgcttacacctcgaagcccacgcggacaaacctgtggccacctacagtgggggaaccaagcggaaactctctacagccctggccctggtggggaaacctgacattcttttattggtgagtagaagaatgtcaatatcttggagtaagatacatattgcatattgatttataaactgattttaagggtttttctgggaagtaacttcagaacttgcaaagctggttctacaaactagtaaactgttttgccataagccagcatttcccaaatgtcatttgtattttacagaaataaaacatttattttttgctagattcacttatatttgtcaagctgaaaattctataaaattttaacattaaaacagtgttttaaaagattattagaattcatctgtaatctgaaaaccaattatgttttcctctagaatattgcttttatgtctttttctgtgtgtagatgtatgtttatcacagcagtagtgacacctgtcatggtgaatcttaaagatgggtgttgagagtgaaggatggatatgatgttgagagtagggaagaaaactccagcaagagggtagagtatatgcaatggtcttgagacagggtggtctataatcaatctgggaactgcagttaatttgatttgaatgaatcaaagcattaattggaggcaacaattgtcaagaaatggagttaattatcttgcatttcataaaacagctataactgttaatacaagtaatgccattgaaagaataaataaaggctattgttacatgccataaattggattctaatcagtagagtgcatctttggacttcacaccagtagagagtctgaggggtgtcaaaaagtgtggaaaacaaaacagattcctttttttctatctttcttcatcaaatgaatacacccttttagtggggtagtaaatggggattgagaaggtctgtgtgggaaaatggtctcatcgtttgctggttgtctcctggaaactcacctgaatattctttttaggtaccataaatttgcttttgcaatgtccaaattcctagactattgtatagtttcatattccagaatctgataataaaaactaccatttgcacaatcctgaagtttacaaattacattttattttcaacatgaggcaggattatgttgagtagttaacaagacgtgggcattcattactttctgtggaatttccctttgcccagcctcttacaatgcatctccttagttgaatgaaggggcctctgctctgtagccatgacctgctcactgcagaccctgacatgcttttctttgatacatccttgctctcagctttccttggatgcccaaacctgtgacagagtggtcaaggtggggactctggagtctgactgacaagctttgaattttgcttctgcagctgcccaacacttggccttgtatgttctatgcctgtttccttctcatctgaaaattttcctgataatagtgtctgtctcatggagtcattgaaagcagtaaataaaataaactacattaagcatatagcccagtgtctagcagatggtaaaccacagtaaatattcgtgactatgatgatggttactgttcagagcaataggttaaagagatttgttgccaggcctttggagttctcaacagagagactagaagtgattctcagagctgacatcaaggagggaatcaggaaaacgtaaattacacatacaactctcataatgagcattgcatgatcacaccttttatttacttatttttataactaatacacatatattgcttgatttgcagaaaagactagatatttattttcctgttcagtgcttctccccctacacttactgcttcccatctgtttctttctttatggaagtttatgaacctaagctcttaagaaatatgtgtttagtactccctggctaataaaagcacagaaatacatcttacagtttggcgagatttctctagaagtggttcatataaggaatactttggtgtctattgaaggagaaagcttcaagttctaagaaatattaatttatttgatgttgctaaataaatgaagcctttttctgctatcatatgtcttcctaggggatatcattccgaaattttatggaggttgaaaattcattttagaaacatcagggttggcttacctagccagatcatggaggagaaccaacctgacatgaaaatatagcccaattcccctcctctcagttttatggaagtataattaactgataaaaatggtatctatttaatgaattcaacatgtgttttgatatacataaatattctgatgtgttgactacaatcaaactaataaacatattgatgacatcacataattgccattttttcccctgtatgtgatgagaacacttaatatctaccctcttagcaaatttcaaatatgtaatacagcatcgttatctacagtccctctcttagttcactgtgctgctataacagactggataatttataaagaacagagaacagaaattcaggttttggagtctgggaagtccaagatcaaggcactgccaggtccaggtgtctgctgagggtgccaaccctgcttcctgaaacctgtgccctccagaggggaggaataggtgtcatcacaaggcaaaagtcagaagggcaaaaagaggtgaatgtccttcatcaggtccttttataaggtcacttaatcttataaactcattcacctcccaaaggtcacacctctcaatactgtttcattagggattgagttttaacatgaattctgtaggggacaaaacatccaaactatagcagccctatatcctgtatattaggtctccagaacttgtttgtcctgtataactgaaattttctgccctttgacaagtatctccccatttccacagcctggcacctttctactctctcttcctatgtgttcaactttttaatatttcactaagaagtagtgtttttccatgcatggcttatttcactttatgcttggcataaagtcctccagattcacttatgttgttgaaaatggaaggatttccttatttttcaggcagaataatatttcattacacacacacacacacacacagtgagagagaggagagagagagagacaaggaaacagggagagagagagaaagagagagagagagacatacacattttcttttcccatttatacacttagggatgcttaggttgtttctatatcttggcttctgtaaataatgttgtcatgaatatagcactgcaaatatcccttccagatattgattttatttcctttggatacacacacagaagtgagattactggatcagtggcagtagtatttttaatttgtagaggaacctccacactgttttccataatatgtgtacatttacatttccaccaattgtgtataagggttcacttttctccgaatccttgccattgctggttatcttctgtccttttaacaatagccattctaacaagtataagatgatatctcattgtggttttcatttgcatttccctgattattaataatgtcgaacatcttttcatatacctattggccatttgcatgtcttcttttgagaaaagtctgttcaagttttttgtctatttttaattattattatttgctatttagttttacgactttcatatataggatgtaaccccttattggatatatggttgcaaatattttatcccccgctgtagtttgtctgctttgttgatattttcctttcttgtgcagaaactcttttcgtttgaaatagtcccactttatgtttgcttctattttatgtgcttttggtgtcatatccaaaaaagaaacaagcaaaacattgccaagaccaatgtcaaggagctcttctttttttttttctacaagtttcatggtttctcatcttatgtttaaatctttaatacatgttcagttgatttttgtgtatggtgtaagataaggaccgagttttaattttttgtatgtagatattcagttttcccaaagccatatattgaagagactgtccttttcccagttttaatttcagtgtatttgtcaaagattaattgactatatgtgtgtgggtttatttctgtactgtctattcttttctatgaatctatacatctgtttttatacaagtaccatactttttaaattataatagcatagtagtatattttgaaaataggaaatgtgaggcctccagcaccattcttcttgcttactttctttagctatttgtggtcttttgggttttttaaatataaatttcagtattttggttttctatttcagtgaaaaaatgacaatggaattgtaggaatagcactgagtctgtagatcgctttgggtaatatggacatttaaaaatattaattctttcaatccatgtacatggatagctctccatttatttgtcttcaatttctttaatcaaaatgttatagttttcagtatacagatctttcacttcctttgttaaaattatgcctaagtattttattcattttgatcttattgtaaatgaaattgtctaaaatttccttttctgataacccattgttattttatggaagcactattgatatttgtatgttgattttgtatcatatgactttattgcatttgtttattaattctaatggattctttggtggagtctatagtgttttctgtatgttagatcatgcttttgaaaagatgattttacttcttttttgatttggatgccttttctttgtcttgactaattgctctggttaggacttctagtattatgttgaatagaagtggctagagtgggcatccttgtcttgttcttcttagatttgaagtttttagcttttcactgttgaatatgatgttagttgtgggcttatgatatatggccttttattcttttctatttctgctaactttgggattagttcatttctttatccagtttcttcaattgcaaaggtaagatatttatttgaaatctttctttttttcttaatgttgatgacttcttcctcaaatctgcttttacttcatcccataagttttgttttgtttccattttcatttgtctcaagatacatgtattttttaaaattttctttttaatttcatttttgacccattggttgttcaggaacatattgttaatttacacatatttgtgaattttacagttttcctccttattaatttctagtatcataccatggtggtctgaaatgatactggatatgatttcaatttttttaaaattgtttagacttgttttgtggcctaatatatggtctctcctggagagtattttatgtgttctggagaagaatgtgtattctgctattgttggatggaatgttctgtgtatggctgttaggtccatttggtctaaagggtagttcaagtacattgtttccttattgattttctgactggttattcaatgtatcattgaaagtggagccttgaactcccctattattattgtacttatgtcttttactcctttcagttttgttaatatttgcattacatatatagtactctaatgtttagtgcatatctatttacaattactcttttatcattttatataaattgaccattttatcattgtatttttctctttttacagtttttgacttaaagcatattttgtgtgacataaatatagataaacatgccctctgggtcatcatttgcttggagtatctttacctattgtttcacactcagtctatgtgtatccaaaaaaactgtactaagtctcttgcaaacagcataagattggatcttggtttttatccattcattcactttatgccttttgattggcaaatgctgtctatttacatttaatgtaattattaataggtaggatcatattcttgacattttgttaattgttttctggctatttttaaagttatttattcttttttttcctctattactgcttttcttttaatttgataatttttttttgtgttggtatgttggtatgctttgattcatttctgtttttttttcttttgtgtgtgtgtgtgtgtgtatgtgtgtgtgtgtgcatcttctataggttttttatttgtggttaccaagaatctatataaaacatcttatagttacaaaagtctatttttaacctgatagtaactgaacttatatcacattaaaaaaaaactacacttttgcttccaaccatctcattttatgttttagatgtcacaatttgcagctctttatattgtatttccattaaaaaattattatagctatagttatttttaatactttgtgttttaatctgaatattaccattataagtgatttatacaccaacattaaagcattaaagtatgctgaatgtggctgtatacttaactttactgtgagttttataatttcatgttgctaattagaatccttttattttgttttgaagaacccctttagcattttttttttataagacaggtattgtgtcaatgaactctttcagcttttgtttgggagcatttttttttttataagacaggtattgtgtcaatgaactctttcagcttttgtttgggaaattctttatctcttttttatctctgaagggcagctttgctgggtaaagtaggtaaagtatttttatttggcaggttttttttctttcataggcccactctttcccagtcctgaagatttcttctgaaaaatccactgatagccttgtggatgtatgtcatgagccttttttttcctcttgttgctgtgaaaattctgtttttcatttttgacagtttgattattgcgtatctcagtgaataatttgttgggttgaagctatttgggaacttttaagcttcatatatcttgatgttcaaatgtctatctctttatccaaatttgggaatgtttcagccattatttatttaataagcattctgctgcccctttttctcaccttttttattttgtaaatctcatattgtaaaagttaggtctctggataatgtgccataaaccctgtcaggctttctttgttcttcttaattcttttttacttttttaaaattttccttgactggataatttcaaataatctgccctcaagttcacagattttttttatctgcttgatcaaatgtgcttttctctattatattttttatttcattttatttttctgcgccagtatttctatttggttctttttttttataattttgatctgttttttgaatttctctggatgaggtgagaaagaagtggggctcctgggtagcatgctgcatggctggaggagtcaggccctcactcattgctctctcacattcccctatcattctggctttgttgagcagagtgcaacaaagccaattggagaggtgtcttttagagccagagcagagatttttctttcacctggggtctggcctcccatgtcattgtgtatatttctatttgtgtttttcaaatgctgattactctgtgttgcctttccttcaggatgagcccagctctgggatggatccctgctctaagcggtacctgtggcaaacaataatgaaggaggttcgggaaggctgtgctgcggtgctgacctcccacaggtgagttccagtttctcttgtagccatttcctgataagactgagtaacaaaggttaagaagtgcatttaggtacctgcacagtgttacacatggacatttcttaatctttacaacacaataatggtgatattattgttagccctcattgtataaattgagactgaagccatgagggattacgttatataaccaagtttacatagcaaataggtggcagagctagaatttgaacctagtgttctgtgtccaaagatgatattcttgcctcatccattgctactgttcaaggatgagtgctagactaccattttcaggtcttcctgagggatctttcagatcctttccatccaaggcctattatttcagcaggtagaattagctgaactaaaatacttaacaggttactgaatctggtttaacattttctttatcacagaattaagtttgtaattagatttcaaaaccattggcttctttttaactttctaatacactgttctagcccacaaagaattacaaatatagatttcataaaacctacttatggggagtgagcaatatgatttaactaatacaaattctaatgatgtaataaagaccaggctttaatgtttagacttgttttgtctttatgtttaagtaaaatatactgtgaataagatgtcaagagctgccaaagatctcacattttgcccttttgcaagctaacaaatttagcttgatacagttttatggatgttgacagaagaaatgagacttctgggtcggagatgaaagactttattgctcacagcaagaacagtagccagagtgtcagcatggtttctcattggttccctaaaccccagtttctattggactaatggatgcctgcacacagaggagaggaatgccaaatctggtgaaattactaccttataacatctgataaggaagccagcccttcgtttgggaggaggtgtcgcttcttccatggttgtttgctactagcataactttgagaaatggcccagttaaagagcagttagggccttatattcttggaattcatggcaagacacgtaggaacacaagggacccatggaaacatgcttcccaacagtctaaatcattcagtctatgcttgagtaccccagctcttgttaccaggagtgaaatataaagctagccctatcatttgaaacgtgagatttctgagaggacctcaggagactttactgattactgcagcattattagtttacgtaaaaatactattaaatgctataactcagcatgcataatcctattacacataaatcttacagccatttcctgtaacaagtgttactggctgcaaagccaatgtattgtgaagaactcagccattcacacatttctcacattgcttcatgtcaaagtagacttttcttaattttctatctctgggctctttcttttttaaaaaaattcattcactgataggtttgtctatactgcttaacattccccaattttcactgccagactaaactttacactgttgtttttttaaatgccattttctgaagtataatttacatttgatataacttaaccactgtaagtatggaattctatgattctttagtaaatttatagacttgtgcaaatattaccataaataagccttagaatatttgggtcacctcccccaaattttctcatgcttactttcagttaaattagcatttgaggctaggtgccgtggctcatgcctgtaatcccagcacgttgggaggccaaggcgggcggatcacgaggtcaggagatcaagaccatggagaaaccacatctctactaaaaatacaaaaaattagccaggcgtggtggcgggcgcctgtagtcccagctactcaagaggctgaggcaggagaatgtcatgagaccgggaggtggagcttgcagtgagccaagatcgggccactgcactccagcctgggcgtcagagcaagactccgtctcaaaaacaacaaccacaacaaaaaaattagcattcaaaacctccacctaggaaaacattgatggctttctgcctctgtaaatttgctttatatggatatttcattaactgaatcatataatcagtagtctgctgcatctcttttttttatttatcataacactttttttttttgagacagagtcttgctcagtcacccaggctggagtgcagtggcacgatcttggctcactgcaagctccgcctcctgggttcacgccattctcctgcctcagcctcccgggtagctgggactacaggcacctgccaccaagcctggctaattttttgtattttagtagagacggggtttcaccgtgttagccaggatggtctcgatctcctgaccttgtgatccgcccgcctgggcctcccaaagtgctgggattacaggcgtgagccaccatgcccggcctatggcaacacttttaaaggctatccattgcgttttatgtcaataggttgctccttttcattccaaacggtatcccattttatagctataccacttttatttatccattcaccagttgataagcatttgggttgtttccagtgttttgctattatgaataatatgttatgaacagtcatataaatgtctttgtatgtatagacatgttttaatttttttagatttttctgagtcaagttgctagattgaatagtaagttgtatttgagactttaagaaactgcagagttatttcccaaattggccttatcagtatatgttcccagcaacaatgatgagtctcctttattccacatccttgtcactactgtctgtcttttttcattataggcatcctagtgaagtggggttttaattcacattttcctaaggactaacgctgttagaatcttttcatgtgcctattggttatttgtattacttctttagtgaaatttttattccaatatctcctccatcctccattttttaaaaatggcttgatactttagaatagttttaggttcactgaaaaattgagaggaaggtacagaaattttttaaatccctccttgccttcacacatgcatatccttccctattatcagcatacattaccagagtgatacatttattaaaattgatgagcctacattgacagcacattaccaccccaatccaatttacatagggttctctcttgatgttggacattttatgggtttggacaaatatctaataagaatccaccattatagtatcagatagaattgtttctctgccctaaaaattttctgtgttccacctattcatctctccctcctgcctaacccctggtaaccactcatctttttactgtctccatagttttaccttttccacaatgccatatagttggaatcatatagtatgtagtcttttcaggttgacttttttcatttagtttctcccatgtcttctcatggcttgatagctcatttcatttcagtcctgagtcatattccactatctggatgtactacagcttatttatccactcatccgctgaaccacatcttggttgcttccaagttttgacaattttgaataaagctgcttaaggatccgtgtgcagttttttgtgtgaacatattttcaactcctttgggtaaataccaaggaatgtgattgctggatcggatggtaagagtatgttaatttttgtaaggatcctttatatttgaattgttttttatctattatttttgaattgtaatagttctttttatgtagcagatattcctatattctgaatagaagtcccttgctggataaatgatttgcaaatatgtatttccagtctatggctgtctttccattttattaataatgtctttcgaagtgcaaacattttaaattttgattacattcagtttatcaatttatttttatatggtttgtgcttttggtgtctcatctaagaactatttgttcaaatgaagtcctaaagattttcttctatcttttttttctaaaaattttagaattttggctcttatatttaagtctttgatctatttcaagctaagttttgtgtatagtatgagaaaaggatataaattcacttttatgcatgttaatatccaattatttcagcactcttccttgaaaagattatcttttatcccactgaattgtcatagcacctttattatattatttattgtatgatttatttttggactctcaattattatccattgatatgtatgcttattttctcacccaataatatcatgttgattatggttgttttctattaagttttgaaaacagtaagtgttattccttcagctttttccttctattataaaatttttcattatcttgaaatatttttcaatttctcttgtgattacttctttgacccttagtttatttagaagtgtcattcaattttcagatactgggagatttttaagagatttttttttctgttattcatctctgatttaatttggttgtcattagataaaataagttgtatgatttccatcattttaaatttgttatgactttttaatggcctaccagaggggttacagttttttttttataaaacaccatattttaattgttttttatctattatttttgaattgtaatagttctttttatgtagcagatattcctatattctgaatagaagtcccttgctggataaatgatttgcaaatatgtatttccagtctatggctgtctttccattttattaataatgtctttggaagtgcaaatattttaaattttgattacattcagtttatcaatttagaactagaaataccatttgaccaagcaatcccattactgagtatttggttttgcaagtcgtatggtgtgtactgcagtatccaactccactgtgtagtgtgaaagcttccaccagtattaggtaaatgcataattgtggttgtattccaataaaattttatttgttcctctcccccatcccccacaaaatggtggcaggctggatttagccaatgggctgcagttttttactccaggcttaacatatggtctatcctagagaattgtctatgcaaaggaatatgtattctgtagtagttggatggaatattgtatatacagcaagtcagcaagttagcttgacagtgttgtttaagtattctgtattcttgggaattttttcctgggtattctatcaattactgaaaataagatattgaaatattcaagtataattgttacatttttcttttccttctttagattctgtcagtttttgcttcatatatttggagtctgtgtagttaggtgaatatgcattcttaattgctatcatactaatattttgactttcttatcattatgaaatgtctctgttttactctagcagtatgttttatcttaaatcctattttgtttcttaaaatagccattgcctctgtcttttggataatgtttgtgtggtatatcttttcatattcttttactttcaaataatttgtgtctttgaataggagtgtttcctatagattgtgtatagttggatattgtttttttttttcccaatctgacaatgtctgccttttgtgggaggtatttaaactgtcccacatttaatgtaattattgatatggctgaagtaacattgactgttttgctattttttacataatgtctcctgtgtttcttgtatctgtttctacttggcagccttatatattaaatgaataatttgaagtatactgtatttaatgttttatctattttttttagttatgttcttactggctagtctaaggatgatagtatacgtcttgatgctaacttaattctagaaaagtgttgtaatcttgccctaatatggctctatttcctccctttttctttgtgctattattaccatatatattgcattttatatgctataaatccaataaggcatattttaagtttcactttatacacttttaaatcttttaaagaagataagaaaatatatcaaaaagacatatccacagtcttaaatagtaatccatacaattgtcatttctgacgcatatctgtccatatgaaaaatgtgagaaaattttggccattatttactcaaatactttttctggtcctatctatctttccttttcttttggtcttccattacgtgtatgttgaaactctgatcttatcgcacaagtctgagttcttgctcattttttttagtcttgtttttttctatttttggattggataatctttattgatctatgtgttcactgactcctctgccattttgaatctggtgttgacccctctagtgaatttttccttaatttcttgtaatctttaactgatttattttttttataatttttatccccttcttcagaatccccacttactaatgtggttgtcagacttttctttaattctttttattttttattattatacttaaagttatggggtatgtgtgcagaacgtgcaggtttgttacataggtatacatgtgccatggtggtttgcagcacccatcaacctgtcatctacattaggtatttctcctaatgctatccgtcacccagcctcccacccccgcaacaggccccggtgtgtgatgctctctgtgtccatgtgtcctcattgttcaactcccacttatgagtgagaacatgtggtgtttggttttctgatttgtgttactttgctgagaatgatgatttccagcttcatccatgtccctgcaagggacatgaactaattcttttttatggctgcataatattccatgatgtatatgtaccacattttctttatccagtctatcattgatgggcatttgggttggttccaagtctttgcttttgtgaacagttcctcagtaaacatatgtgtgcatgtgtcatcatagtagaataatctgtaatcctttgggtatatacccagtaatgggattgctgggtcaaatggtatttctagttctagatccttgaggaattgccacactgtcttccacaattggtgaactaatttacactcccacccacagtgcaaaagtgttcctatttctccacatcctctccagcatctgttgttttctgactttttaatgatcaccattctaactggcctgagatggtatctcattgtggatttgatttgcatttctctaatgaccagtgatgatgagctttttttcatatgtttgttggctgcataaatgttttcttttgagaagtgtctgttcatatcctttgcccactttttgatggggttgtttctttttttcttgtaaatttgtttaagttctttgtagattctggatattagccctttgtcagatagaaagattgcaaaaattttctcccattctgtaggttgcctgttcactctgatggtagtttcgtttgctgtgcagaagctctttagtttaattagataccatttgtcaattttggattttgttgccattgcttttggtgttttagtcatgaagtctttgcccatgcctatgtcgtgaatggtattgcctaggttttcttctagggtttttatggttttaggtcttacatttaagtctttaatccatcttgagttaattttcctataaggtgtaaggaagtgatccagtttcagctttctgcatatagctacccagttttcccgacaccatttattaaatagggaattctttccccattgcttgtttttgccagttttgtcaaagatcagatggttgtagatgtgtggtgttatttctgaggcctctgttctgttcccttggtctatatatctgtattggtaccagtaccatgctgtttctgttaccatagctttgtagtatagtttgaagtcaggtagcgtgatgcccccagctttgttctttttgcttaggattgtcttggttacgcgggctcttttttggttccatatgaaatttaaagtggttttttttttccaattctgtgaagaaagtcagtggtagcttgatggggatagcattgaatctataaattattttggacagtatggccattttcatgatattgattcttcctatccatgagcatggaatgtttttttcacttgattgtgtcctcttttatttccttgagcagtggtttgtagttgtccttgaagaggtacttcacattccttgtaagttgtattcctatgaattttattctctttgtagcaattgtgaatgggagttcattcatgatttgactctctgtttgtctgttattggtatataggaatgtttgtaatttttgcgcattgattttgtatcctgagactttgcttgagttgcctctcagctttaggagatttagggttgagatgatggggtttgctaaatatatagtcatgtcaactgcaagcagaggcaatttgacttcctcttttcctaactgaatatgctttatttctttctcttgcctgatagccctggccagaactttcaacactatgttgaatagtagtggtgagagagggcatcctcatcttgtgctggttttcaaagagaatgcttctaggttttgcgcattcaatatgatagtgcctgtgggtttttcataaataatcttattattttgcagtatgttccatcaatacctagtttattgagagtttttagcatgaagggctgttgaattttgtcgaaggctttttctgcatctattgagataatcatgtggttttcgtcgttgattctgtttatgtgatggattatgtttattgatttgcatattttgaaccagccttgcatcccagggatgaagctgacttgattgtggtggataagctttttgatgtgctgctggattcagtttgtcagtattttattgaggattttcgcatcaatgtttatcagggatattggcctaaaattttctttttttgttctttttctgccaggttttggtatcaggatgatgctggcctcataaaatgagttacagaggattccctctttttctattgattggaatagtttcagaaggaatggtaccagctcctctttgtacctctagtagaatttggctgtgaattcgtctggtcctggactttttttggttggtaggctattaattactgcctcaatttcagaatttgttattggtctattcagggatttgacttctttctggtttagtctttggagggtgtatattatttcagtaatttatccatttctcctagattttctagtttagttgcatagaggtgtttatagtattctctgatggtagtttgtatttctgtgggatcagtggtggtatcccctttatcattttttattgcatctatttgattcttctctcttttcttctttattaatctggctagtagtctgtctattttgttgatcttttcaaaaagcagctcctggattcattgattttttgaaggatttgttgtgtctctatctccttcagttctgctgtgatcttagttatttattgtcttctgctcgcttttgaatttgtttgctcttgcttctctagttctttcaattgtgatgttagggtgtcaattttagatctttccagctttctcttgtgggcatttagtgctataaatttccctctacacacggctttaaatgtgtcccagagattctggtacactgtgcctttgttctcactggtttcaaagaacatctttatttctgccttcattttgttatttacccagtaatcattcaggagcaggttgttcagtttccatgtagttgtgcggttttgagtgagtttcttaatcctgagttctaatttgattgcactgtggtctgagagactgttatgatttccgttcttttgcagttgctgaggagtgttttacttccaattatgtggtcaattttagaataagcatgatgtggtactgagaagaatgtatattctgttgatttggggtggagagttctgtagatgtctgttaggtctgcttggtccagagctgagttcaagtcctggatatccttgttaattttctgtctcagtgatctgtctaatattgacagtagggtgttaaagtctactactattattgtgtgggagtataaatctctttgtaggtctctaagaatttgctttatgaatctgggtgctcctgtgttgggtgaataaatatttaggatagttagctcttcttgttgcattgatccctttaccattatgtaatggccttctttgtctcttttgatctttgttggtttaaagtctgttttatcagagactaggattgcaatctctgctttcttttgctttccatttgcttggtaaatattcctccatccctttattttgagcctattttgtgtctttgtacatgagatgggtctcctgaataaagcacacccatgggtcttgactctttatctaatttgccagtctgtgtcttttaattggggcacgtagcccatttacatttaaggttaatattgttatgtgtgaatttgatcctatcattatgatgctagctggttattttgcctgttagttgatgcagtttcttcatagcatcgatggtctttacaatttggtatgtttttgcagtggctgataccagttgttcctttacatgttcagtgcttccttcaggagctcttgtaaggcagccctggtggtgacaaaatctctcagcatttgcttgtctgtaaaggatttgcttgtctgtaaaggctggatatgaaattctaggttgaaaattctgtacattaagaatgctgaatattgtcccccattctcctctggcttgtagggtttctgcagagagatccactgttagtctgatgggcttccctttttgggtaacccgacttttctctctggctgcccttaacattttttccttcatttccaccttggtgaatctgatgattatgtgtcttggggttgctcttctcaaggaatatctttgtggtgttctctgtatttcctgtattggaatgttgaccttccttcctaggtttgtgaagttctcctggataatatcctgaagagtgttttccaacttggttccattctccccatcactttcaggtacaccaatcaaatgtagatttggtcttttcacatagtcccatatttcttggatgctttcttcatttcttttcactctttttctctaatcatgtcttcttgctttatttcattgaattgatcttcagtctctgatatcctttcttccacttgatcaattcagctagtgatacttgtgcatgcttcacgaagttctcttgctgtgtttttcagctccatcaggtcatttatattcttctctacactgattattttagttagcagttcatctaaccttttttcaaggttcttagcttccttgcattgggttagaacttgctcctttagctcggaggagtttgtgattacccaccttctgaagcctacttctgtccgttcgtcaaacttattctccatccagttttgttcccttgatggcgaggagttgtgatcctttggaggagaagaggtgttctggtttttggaattttcaagcctttttgctctggtttcaccccatcttcatggatttatctacctttggtctttgatgttggtggccttcagatgtggtctctgagtgggcgtcctttttgttgatgttgatactattcctttctgtttgttagtttttcttctaacagtcaggcccctctgctgcaggtctgctggagtttgctggagatccgctccagaccctgtttgggtgtcagtggtggaggctgcagaacagcaaagattgctgcctgttctttcctctggaagcttcatcccagagggtcacctaccaaataccagccagagctttcctgtattaggtgtctgtcagcccctaccgggagctatctcccagtcaggatacacaggggtcagagacccacttgaggaggcagtctgtcccttatcggagctcgaacactgtgctgggagaaccactgctgtcttcagagctgtcagacagggacgtttaagtctgctgaagctgcacccccaaccaccccttcccccaggtgctctgtctcagggagatgggggttttatctataagtccctgactggggctgctgccgtttttccagagatgccctgccgagagaggaggaatctagagagacacttagccttgctgagctgcagtgggctccacccagttcgaacttcctgagggctttgtttacactttgagggtgaaaccgcgtactgaagcctcagcaaggacggatgcccctctcccaaccaagcttgagcatcccaggtccacctcagactgctgtgctagcagcaagaatttcaagcccgtggatcttagtttgctgggctctgtgggggtgggacccgctgagccaggtgccaggcactggaggaaatctcttggcctgctggttgcaaagaccacaggaaaagcgcagtatctgggccggagtgcacgttcctaccagtacggtctctcacagattcctttggctaggaaagggaaatcccctgaccccttgcacttccacggttgaggcaatgccccaccctgcttcagctcaccctccatgggctgcacccactgtccaaccagtctcaatgagatgaaccgggtacctcagttggaaatgcagaatcacccaccttctgcgtcgatctctctgggtgctgcagactggagctgttcctattcggccatcttgccagctctctctttaattctttaaacttggttttcgttagttctttgatgatgtttataatagctgcatttaaattttttcttctaaatctagcatctgagaacacttatgaacaatttcttttgactgctttttcctccccagttatggggagaaactttcttgtttctttgcatgccttaaaaatttatattgagaactgcacattttagataattgtagcaggtctggattctgattctccctcccctgtggtggttattgttgccaatttgtaaaaagtttatttgtttattttgtgtttgtgtcttacttatttgcctgagataaatctgtgaaaactctcctttagtgagtagctacctactcctctactcattttcttattttttatttttatttttggaccgtctcattctgttgcccaggctggagtacagcaatgcaatctctgcttactgcaacgtctgccttgtgggttcaagtgattctcctgccttagcctcccaagtagctgggattacaggcgcctgccaccatgcccagctaaattttgtatttttagtagagacagggtttcaccatgttggtcaggctggtctggaactcctgacctcaggtgatccacccacctcggcttcccaaagtgctgggattacaggcataagccaccatgcccagccagtttgttttttaagactggctcataggagtcactctgtttatgcataggctagttgctagtgagtgactgggcacaagttgtgctcaaccacctgaggccaacaaggtttttgtctttgcaaatgtatctgtgtgtgggtagtgaagaaattagaagttcaggctattttcatgttagcctaactttactggctccttttgtgtctctcctatgtgcatgtggacagcctctgggttcacaaagaacatgtggctggcctgggccctctccaatctcagctgcacatacatgcagccgcagctatatgcatgctacatccacgtaattccagtctagtagaggccagatactggaggaattggctttttctgtttgtttggctcccaaataatcaggtatatcaacagtgtcactggacctgggcattacccaatggtccaaattgtttgcatcctcttcagctggggcagagaagctgctgatcctcatggtctgcccttcctgccagtagttgcatgttttcgaaactagggagagtggggagcagcctatggctggaatgccactgattatcagtcttcttatcctaagtttagcaatttgtcagctaaaagtgcttcttagattgtggtatgctttttgttcaattttcagaattttgaaatggctatttttgttaattttgtccagattcatcattgctttttgagaaaacaatttaccagtttcttcatttgaccctagttggaagtcctaccctgggatttgttgttgttgttgttgtttttcttgtattttacttcagaaaataaaattttacattgaaatgaattaaatttgataaaccttctactttatcataatgcatacatgtgtttacttaaaacgatcattttgctttgccagttctagaaactctctacattcttgtatttattttgctggagtttgctggcatgagaacatgagccttcatgttcatgcagaggttctaagattggataaactggtgtcatgacaaaaatttcatttatttctcatataattattagattgttctcagaaagactgcatatcattgcaatttctcttttaaatcctcctattcatttggtttcacattaaatatatatatattcatttccataaatctgtccatatccatgcagtacaaaggtcaaaattactcactgtcgatgaagagtggggaagcttatgatttatcctgtgattctaaaatggcagactttgttgaaaaaaagtctcgtattggacattttcccctgaattttgagtttatttatcattgcctcttctggttccttaccccagggaatcttggtaaagcatggagcaggaaactgaggataagaaccttgcgtactacttttcttactaagggagttgaaatcagtataatcaagaatgaccaacactacttttttctcacacatccaacatcatgaattccaatataactcctgaaatatctgcattgcctagccatatttctgtactaattagattatccagccatacaggaaattttgtgtttattttttgaagctagcacatcttacgtggccagagaaggagaaagagtgtcaaggggaaggtgctacacatttgttaacaaccagatctcatgagaactcactcactatcacaagaatagcaacagggaaacctgccccatgatcaaatcatctccggccaggcccttccaccaacattggggattacaatttgacatgatatttgggcagggacacaaatctaaatcatattatttcataactggcctctcccatatctcatgtttttctcacactgcaaaacacaatcatcccttctcaagattcccccatgtcttaactcatttcagcatgaactcaaaagtccacagtccagagtttcatctgagaaaagtcaaggcccttctgcatgagcctgtaaaataaaaaacaaattagttacttccaagatacaatgagagtacagacattgggcaaatacacctgaacaaaaaggaagaaatcagctaaaagaaagaggctacaggccctgagcaagcccaaaacccagcagagtagtcattaaattttaaagctccaaaataatctcctttgattccatgtcccacattcaggccacactgaagcaaggggtagattgcaaggccttgagcagctccgcccctgtggttctgtggggctcggctcccaaggctgctttcaagggctggcattgagtgcctgtggcttttccaggagcgcagtgcaagctgtcagtggatgtaccattctgtggtttggagggtggtagccctcttctcacagttctactaggcactgccccagtggggactctgtgtgggtgctcaaatcccacatttctcttctacactgccctagtagaggttttccacgagagccacgtccatgcagcagacttctgtttggacagccaggtgtttccatacatcctctgaaatctaggtggaggctcctaagcctcaactcttgccctctgtgcatccgcaggcttactgccatgtggaagccaccaaggcttactgcttgcactctctggaccagtagcctgggatttatctgggacaatttaaccatggctggagctggagcagctgcaacacagtgagcagtgtcctgaggttatgcagggcagtggggccctgggcctagcccacaaaatcattcttccctcctaggcttccaggcctatgatgcgaggggggctgcctagaaggtctctgaaatgcttttgaggcattttccccattgtcttggctattaacattcagctcttctttacttatgcaaatttcttcagccattcctcctcagaaaatgtgtttttcttttctaccatgatgtcaggctgcaaattttccaaacttctatgctctgtttcccttttaaataaaaattttaatttcagatcatgtcttcgctcatgcataacaaaactgaactatgctccagtttccaataagtttctcatctctatctgagatctcctcacccttgacttattgtctgtatcactatcagcattttggtcacagcaatttaacaagcctctaggaagttccaaactcccttattttcccatcttctcctgagccctccaaactgttccaacctctgcccattatccagttccaaagctgctttcacattttcaggtatctttattgcaatgcccctctgtctgtaccaattttctgtattagtttcttttcacactgccatagagaaaagaagtttaacaggctcacggttccacaggctgtacaggaagcatggctagggaggtttcaggaaacttacaatcatggcagaaggcaaaggggcagtgggcacgtcttacatggccagagcaggaggaagagagtgaaaggggaagtgctacacacttttaaacaaacagatctcacaagaactcactatcatgagaaaagcaagggggaaatcggtcaccatgatccagttacctcccaccaggcccctcctccaacacaggtgatcacaatttgatatgagattttggtggggacaccaacacaaaccatatcagacctccacttgtctgaactatgtttaagaaactaatatataagtgacttaacattctacctctttaattagagtacctacagtgcacccataagatgattacttttaaattgaaattaattaaagaaatatgtgtttgtacaggaaaatatataaagcatatttggaaaatttatgacatgtatctcttggacttcatgctaagcaactataacaaagaaacctcaacttacagtggcccagacaagacacattttttcctctcgctaaattcatgtcagtgggctgtgcatcatcaggccaaccaaggccttgggttctttccaccgtgccaccatcaccatcatcatggttgatgttgactcatcagcaccgtatctacatcctagctcaagggaagtggagaaaaacaaaatccaggtcaagtggcttgctgtatttcaacatgacccagaaattgtgcattccattgagctgagtttgttgcatgtccacattgaggtgcatggaaggctgagaaatatcttgatctgaatgcccattaacccacctaggagactgctttatgactgttctccaataatataaataacacatgcttcctgtagagcatttggttatgcaaaatggtaaaataagtaaagaaaatccatcattaatttcatttttgagatattgacagtcatacttttttgtgtgtttttcttactaggtagttttttaacatacctgtgcaattctctgaatacacattgtcattttaccattgctatactatgaacttttctccatgtgattaattgactttagtgaacctcattttaatagctaacacatggatgaactcttacttaaatgagtgatatattctcctactgtgaaacattaacctgtttccagatgcttactattataaataagttgttacatgcatttatattttcagtgttttctagggtaagttcttaggaaagtaattactgccaaattggtgttcaaaaagttatgccaatttttactcccaccagcaatatatgagatgacatattgagaattactgagaaaatggccttaactttctgggtatttttttttttatttgagaactcattgtttttgaagtgacgattggaaataaaaacccctcgtttttctctacaatacacaaaagtacacatgaacacttttccagcaagaaaatagttttaaaatcaatttgatttaatggtttatattttataatttgttggcatgtttattacccacgagcagttctttgaatggtctctacatgttatttacccttttttctctattatatttttattattttgttttaaactaacatatattagttctttatagtaagtatatcaacctctacccagtaggtctattggaatttttttctttcttttttttttgagatggagtcttactcttctcacccaggctggagtgcagtggcaaaatctcggctcactgcaacctccgcctcccgggttcaagtgattctcctgcctcagcctcttgagtagctgggattacaggtgccccccaccacacctggctaaatttttgtacttttagaagagacagggtttcatcatgttggctaggctggtctcgaactcctgacctcaggtgatccacccacctcggcctcccaaagtgctgggattacaggcatgagccaccacgcctggctggaattttttaatgctagtttgctgtgttaagacacaacgactacaaatcccttaatagcttcttccattgcttttctgcttagaaaatatcttcccatattcaaatcattatgtatataagatagtaacatcttgttccttgtaattctttagtgtattactgaattgcaattattttagttgtatagaaaatatttatgttttctggagcaagtcttctttcatgattcctctttcattttttttcttcctttcactaagtaattttaaaggtatactttataattattttaaaattttctcatgggagtgataaatgtaaaattttgattagatttactatatctgtattataatatattttcattattataataatataattatagattaccaattttgtaacatatttcaaattgaaatgtcaaaatataatttaaattataattacacattaaaatgttatttatggtattatattttatattatgcaccatattaaaatacaacttatttatattttacatataattaatttacttatgttttatgtttacacttaaggtaatatttaatatttatactaacatattaatattattttatattacactaattttcatattataacagtttttccattttcaaaatatccattcttttcttttcttccatgcctccttccattgattcaatatttcatttgtgcctattagtaaggcttccttgtttcttttcataaaacattcacattgctttgttaagattattcttattttgtatttttgtactattgctaaatgcttctctcctatatattttatagctggtcttcctggtataagaaaatactgatttttgttagaatggcaatcattaaaaagtcaggaaacaacaggtgctggagaggatgtggagaaataggaacacttttacactgttggtgggactgtaaactagttcaaccattgtggaagtcagtgtagcgattcttcagggatctagaactagaaataccatttgacccagccatcccattactgggtatatacccaaaggactataaatcatgctgctataaagacacatgcacacgtatgtttattgtggcactgttcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctgagtaaactatcgcaagaacaaaaaaccaaacaccgcatgttctcactcataggtgggaattgaacaatgagaacacatggacacaggaaagggaacatcacattctggggactgttgtggggtggggggaggggggagggataacattaggagatatacctaatgctaagtgacgagttaatgggtgcagcacaccagcatggcacatgtatacatatgtaacaaacctgcacattgtgcacatgtaccctaaaacttaaagtataataataataaaataaaaaaataaataaataaaaaagaaaatactgattttttgttaattgtaaaattggctgtctaaataaaaccttattgttttcaaaagcttttgatttggttaccatgagatttctgtgtaaaaaaattaagtaatttgccctaatggtatcttgtctcctttttgttttgaaaagtttgactcaaccctcccctcttcaggaaatggctcatttttgtctcttttccttctttacagcatggaggagtgtgaggctctttgcacaagactggccataatggttaacggcagcttcaaatgtcttggttctcctcagcacatcaaaaataggtgcgttgaagttctccttttgcttagatatttactatgaaatcaatagcatgatgcagggttatgactggagatgctttagaggcaagtatgttccaattacctgctggcataaaataggagatgaaggctctgaggggataaaatactgtggctagtaagtcaaacacatagcaactcccaaacacagtctagtgttctccctgtaagggagacattttgcttttctcttgccaggtagacattgctccctccttgtagtgacattggtaggggtgagaataagattgcagagtcaagatgatgacaggacacaaaatgtcctctttacacacaaaatgccttatgaaaaggctgtgctgatatgtccctcatctgcagtgaatcaaagttcccattttatcctaccaaacactatccttttgaaaaagaccatcaatttataagggtaggagagggttgttatggttgctttccatttggattatgaaagactaaagacttctttcctgtgctcattgatcctttatatttcttcctggttaattctcttcatgtattttctttatttcctttttggaatcttaataattttgttatcaatttgtgtgagcattgttacatcctggtataacattaaaaaaattaaagttgcctaaatacacgtccaattttcctttgatttgtttaacctgtcattctatgtagaataatttattcatttatgttgataaatctcttattttcatttattcagtgtttttaaggttaggattctcaagcagagatttggtaaatagtcatatgtaaattttaaatacttttaatttatggagaaaatagctgatgctcaggattgagatgacatagtagggagtgagtgtccatttttagagttaggcactgctgggatggtcagcctcacagttgcttgctgcttcgggtcaaccactggtcagatgcacctactggaaactattctcggtatgtactctgcccatctttaataagtatcatcaaaagaaaaataatatttcatggtctccaacctttatgaatgcctacataaagttttataacccattcttgattgttgggtgatttatgtctgatttatgtttacaaaagtttcccacaagagccagcaggacgaagcacatggggataggttttctctagctgttgcattctacatactggaaaatctgtgcctacttcggagtttgggttcccataatgtgatatatgggttgagcatgaattgttagtggatatgaactgtaggactatattaaacaagaaatggcttgtgggttattcactgaaacatcaaacttaataaaatttaaaaaataatttgtggccgggtatggtggctcacacctgtaattctaacactttgggaggatgaagtgggaggatcacttgaggcccagagtttgagaccagcctgagcaacatagtgagacctcattcctacaaaacattttttaaaaattaattttaaaaaattatatccaggtgtggtggggtgcatctgtagtgctagctacttaggaggtaggagaatcagttgtgtccaagagatcgaggctgcagtaagccatgattgtgccactacactccagcctgcgtgacagagtcagaaaacaattaaaaagtaaaataaaataatttgtaaaatgcttattctcctataactataaacctataataaacaaacacatgatgatgcctgtttctataatattgagataaagaataaaggattgatcatgacatagatggtaacaataactagatttttcataaacttcggcatccatacctgggagttagcaacatcagaacccatttctctgacgtggaggtgttgagatggatgagagaacttgtagtgggtctccttcctcctcctctccatccctttctttccatgaacatgaattgttaggaacgtgaataaggaagagtagggtctgggtgagggaagaggttctgaggagataactcaggagaaggcgagggttttggagggaagattatggctgaatttgggcagggatctgggtgtcaggatttccccgtggagaggcaggaggctggtgaggagggtcccaggcttgggctgggagacatctgcccagagggagaacggaagagaggagctacagaaatcccacagaggggggacccagagggcagggcttgggcttcagagaccagctccccttgggaggggcaggtgcaacaagagcctgcaatgagagcctagtggagtgaagccaggagagcacgagggtttagtcacctttagcttctgaattgcagtgctgaccttgacctcatgaacagtcgggaacccttcagtgcaggtctcagcaaattcgcccgtgacaggaagctgaggcttgcacctgctacgtcagttcactcggacaaagcagccatttttcagggtgaagtggggaaagtggaaaaggaatgtaaggatcagaaaaatgaggagccacagaaatatagagggaagaatgtccgtggcaagtagggacagatacataagaggaaaaaacaaaatagaaagtgaagtgaaatttcccaaaccaaagaacttttcctacctcactctctgccccaggcacagccctcagagaaatggggcctcagatgagaaacagctcttccatgggacttcagaccccacctgggctccctgagttcatcccaccttcctgagcctggggagtaagacccaagcacagggatcactttctaccccaatctgcaggtggcactgtctttccttcccaccctctgtcggttcagtcagccccgtaaacccatgcctgactctgctctgattctcttccttcctgctgtgctcatttgagttgctttcttgggtcttaagcaaaaccttggtacatgcacttcaccatctgagaagggtttccgcagaggacaccaaatcccattcccatgctcctaacagagcattaacaccccagcatcctgcttcattcctggactgacctcatccttagcccactgttttaaaatatagtgtgttaatagaaaaattgaagtacaataaggccaatagatcaggaaacgactgcctttgaaaataccatgtattacagtttccaataataggggcatggcacacagggtcccatgagggagcatcaggtcagccaggaggcagagggcagctggaaggaaacctgagcaagggattttattgtgatttctattggaaggaaggggtgaaatagggcaagcaggcctaggatctgctactttgaataactttagtgggctgtgcagcataggggttgtccctagttgtctagtacctgtgcctggggtgactgggggaggtggattgtggcttaacatgtgagagccccttagaggaggtgtttgagatgatgtgtgctctgggtcagctggtttgtatttgaaaaagtgaatttatttgcaagttgtttactatctttaggaattggctagctctgggaggggcagttcttccagagtcagcaagtccccactttttcaaagtattagaatacagaagataataggcatggttaatacacacactccaggactcactgaggctgagtggagccataagggcagggccaatcacattctgcctgcctggaggaagccaggcttgcccactttgcagaggaaggcagggagctctggctgtgccaagggttctgaagtcccccttctcttccttggtacagacttttgttcttcctgggaatctttaatagcttgtttcagagctattatctacatagtgaatttccaaacactttgagattatagagttgtattaaaaagcaagttccttggacccctgatctatggataacctaaagctctctgtgaccggtctgtaccaatcatccatggagaagggcctctgagaaaaaaaaatgcaataggccactatctagtgtgtatgtctatccattgatatcaagttgttatgttaactgtgatgttgtttcttacctgagtcacaatttaagaaaagtcaatcaatattagatcttttgctcgtaaaactgaggctgtttgcttctgacatttaatatttctttaacaaatgtttattgaaacccagcaagggcatgcagaggtaggtctgatgcagtttatgcctgctttggtactcacaagtgcagagagtgagtccggcacatgcccggtgacatcacaaggcctaacagggcaggcaacatagaaaaggtatcaactagagtgttccgtgaaagtgtcatatatgccaagtggcctccaaacccaggaaaagccgagaaatcaaagaaggaggaagacacatccagtttgttggtaaagggcgatttcctggggtcacttatgaatggaagtgtggtcttgggaagcagcaagacaggtagacctctgcaacattactccccagacccagggctcttatatcacagggaaagggcacctaccctagagagacaattgaagacacccctccataacaggcaagagtttttcatgcgttatgggctatcatttgtgcaataacttaagggttgccttgatctaaaggcaggagcacttgttcttacaggaaggacaggaagtgaagtaggaatcaggaggcatttgcgggcctaggctaaccagaagtcaatgtggtagattagcatccatgatgcagtcacttttgtctccacatggagctctgaggaggaggaggaggaggccttttttagtttgaggaaatagcgaaatatcttagacctggagtacaggtaaaatttggttaaaaggggatttaattctggattgtatttagtaacaaaaaatcactacagaattggaatttgagagcaagtaagagggacagataccagtcaaagcaaagtttagatttcaatatgaaaaataaagaaaatcctcaggctaagtaaaagcagcatgaccattttaaatgttccttgagcaaccctcggcttcatggtcttaacttcgtttctgcagctcagcactgtttcgttttgggttggataattcttggttgtgggaggttgtcctgggcatgtaagatgtttagcaccatccctggcctgtgcagcaccctcaccccaattgtgacaactaaaaatatctcttgacattggcaaatgtcttttgggcagcaaattgtcctgggtgagaaccactgtctcagctgttactttgttctatgtccccagagacatggaacacactaggaaacctagttacaataatagttagaccagattccaaaaacattaggcagtcaaccctgtctttcctatggccagatctgaaacgtgtcctgctcagtggctaagaggaggcaggtgtatgaagtaggaggatgtcagcaaatgggcacaaggatgggtagagggcgttgcacacagggcattgtcttaccagaggcaaacactctgggctgtggagtgatctcattttgcagaagtccaagatccatgagaaaggagtgccctcttctcctttcagtcttagtacagccctagtatgagatgtatgaagtcatagtggaaagccagaggtcctgagaggagctgcaactctgcaggccagcatcactcaggtgctttctcatgcttctctaaatacatccctaccccacctcagtgcctgttctcacttgaacaccttgcttggaccactccccatcactgattacacaatactcccacccacagacaccgaggatgattcttcctttttccttgagacttctctggctttttcattgcttggcattttcttccctttgcttgtgtttttttctttatagcaataatcttttcctcttctttggcataagtttgcatcctgcctgccaaaagatctgttcgtagagtgtttaatatccacaatcttacctcgttccaattcagtgttctgctcctagagagcacagactttgtcttttatcagtcctacttttgcgatatgctcaagtatccatgtgatttaggagataaaatatgagggcaatgacaaccagtccagtcctggaggtcttggtgtctgaaaacccaggggtaccacaataaagaggatatgtgtggtcctgaaatgtttaggttttagttcaccaggaggtttaatactgccaaattctacattcattatttactaagttggtgtcctatgctcttctcaagctctagatcttcttgttatagttccttaaattatttttttgatacttctaagtagttaaacaatgattttaactttagattggtattccaatgtatttctaaactgctgtatgtgttcataagttaagaactaaccaaattaaagtttaaagaatcatgtctatggtttatcacttcaacaaaataagccaacaatggatttctattagtgggatttagctaaaagcattttcctgatgctggtttgggacctcatcatgcttttcctggcttcagccaacaccaactgccccaatcctgagtctggtgcaggtggaaatatttgttcaaaattggtaattgatttcccagaaggacagacagcatctagagtatagaatttcggggacccaacctcatagggaaaagtgtatttgctccctccctggtcatcttgacctcattccagcgcttcccttcttctctcccacccttatgaccctctggcctatttcaactggagaaatcatcaagtccctccttgtcccctctccagcctgcaggactcttgctaagcctgcaaggttgtcacagagtgctcctcagatgcattcttcagctgtccttcctgtggcattaccaaaacacaccctcaaaggattattattatttgttctttctgccgaaccttctctctcctaatccattctctacttctcagtttctctagcctggacccagtttacacctgggctacacctgtgccattttcctcttggagcagaaggggttagaatgctgctggatgtcctccctttgggctcaataaactcctggaaaattctcttctccccttttactccctggcaaaggaaaatttaccccttataaaatctgtagagtgtgtcctaacgcgcaatactggaccatctcttagtgatgttatgtccccttgtcttgcatcactatattcccttcttcttgcctttctagcctatagatattccccctttcctaattgtcctcatcctcatcttttatctcttttgtcttcaccatttattatagtctgttacctactgctctgagcaagatatatagattatctagcaatctggataataatattgagaactaattcttatatagtgcttactgtatgccagctgtaagtgctttatacacatgaatcaatttattcctcatgacaatcctacaaagtagctgttattattacccttcatcttataggcataaaaaagtagtcatagaaaggttgagtgacttttccaggattaccatctagtaagtagagggactgacatttgaaccccagcattctggtgctactttgctctatgatgcatcatctcatgattgtccacatttaacaaatgaaagaagtgagcctcctacctgtggtggagctgcctttcaactgcagccagtctgactccaagcttgcaggcctggtcaccatttccgcttccttcctgctggagcacttcccagagccgtaagcatgaacatgcaaactctcgctgcatcttcaatggtgtctgcaccagcaactctctcttgttgacatgtcttttggcaaaattttaatatcttttccattcctattgagacctcatcatcctactcatttaacaagtaatttctaatttcctgagagacacctcttgtcagctagctttttgatgggctctcacaaagtttttatttcttcgttatccttttctttctttgtatctatgtctgagaaagaaatctgcttaattattgagtgtttttattctgtttgatgataacataatcgatttcccttgggatgccttctgtcagtggttttattctgctttacatccttgatcttttcacagtcaagagcagttaataacagaacatcaaccacattgacttaaccatattcatcgttatttgtagtaagaatccagaggtaactggttattggcattccttaagaggtcctaggcctgacagtgtgggtgttcccaaagtggctgctgtagctccacccaatatatatatgttctaggcaacaactaagaaaagcagagaaaagcaaaaagagcacatgccaactgtctgttccctcttaaagtagctttctgtcagagtcccacccagcaacttgtacttaggtttatttgtcacctggctacaaagaagtctaagaaatgtagactctagctgggcactttgctacttaaataaggttaggtttctgttcccaaggaagatagggatcatggttgtggagtgggaagcctgcagcctcacttattcacctgactggattcttttcctccattgagggtaggtcgttaggttgagcagctgagctgaacggactcttgggctttcaatttaagattgtcatatgctatgaaagagccctatatggtatagagattcatgagtttacgtgtgagcacatgatagagtgtgtgtgtgtgtgtgtgtgtgtgtgtgtgtgtgtgtgtggctcagttaataacagaggagagctggagtggagtggcactcacctaatagccacaggtggctaaaactatccttttgggcactgatgttttgtcccaggcaattagggatgcatcctcaaatcctctgcatgtcataaattgagcacataatggtgccctggtagctagctgcctttgtacttgcagacactgagcatattcccaacttacctggagggaaccattaacagctgcatgcggcatctatttgcttttctcctcccttgaacctgattgacataggaggcttaagtctgacttggtaaaaacactcctgtcatggaaaggaaataaaacatgcttctgaagcacagagtttacaatgtgaaatactccaggccaatttatgattttggggtgagggaggataaaggctgtgtattttgttgtcgttgttgttgttttcttttttctttttttttttttagacagagttttgctcttgttgcccaggctggtgtgcgagtgcaatgacacgatctcggctcactgcaacctctctgtcccaggttcaagcgattctcctgccttagcctcccaagtagctgggattacaggcatgcaccaccatgcccagctaattttgtatttttagtagagatgaggtttcaccatgttggtcaggcaggtcttgaactcctgacctcaggtgatctgcccgcctcagtctcccaaagtgctgggattacaggtgtgactcaaggcacccagcctgtttgtttgtttttctttctttctttcttttttattttttataaagaaaacacagcttcaaatgatttaaagaaaattgttaagattatgagaatttacatttccttgagttatcaactgtaaactttgagaaccaagaataaaagtagaataaagttcaaaggatcccatcatagatgtgttatatagccatctaagttaaaatataaagaatagtgtagaagggtttgtttgtggatttttttcctaaaaaaaatgaaaggaggcagaatcttgtttgagctctcaagctaccactgtctgagtagctgcaaattaatgtatcaccttatgtgacaccatatgctttagtgtggcaactttgacttaatatatctataaaccattactataatcataacatctcggattaagattgcatcaccacataatgaagtggatcatttaaaagtgaaatagataattcagtatgtttatgtcactttcacaaatggggaaggaagtttgcacatgagcacaaaaataatttctgccatgatgtggaactatggaatgatgtgctactgagttatatttttctatattttactttagtttaaagcatcatataattcacctgctgctactaaccactgaattaattctctttactagaaatgattttaagagagatagtgcacctccatatcctcagcgtgtttcacctcacctgctatgtgtaatttgtcatctcatttgttgtcacaacatcatgttgtatgaacacagcattgctctgacataattagctgggaagactttctgattctcatgccattctcatgctggacattttggttagctgcctctggtcttggaaattcaggtcatgaacagtatcacccagagctgtcactttatcaaaagtaaacattcggcattcattttttaatattttctgtaagaataaacagaatgcttttcactcacaatgaagatggaaaatagaagtgttggagatatttttagatgggtgaagttgttggggactcagactcacatcatgagtcctgttcattcatacacatttattgagtaaccacttaattagagatgatgaaaatgtgattcctaatctcaataaactcggcatagtgtacaggcagaaacataacaatgaatacaacacaatatgataattgttctaagagactggtgaacgaaatgctgtgttgtgcatctcagtttaaacctgcaaacattactgaatgtttacatagtgccagggtcttgggattgagtgggtaataaggcatgagccctgtaagaactgggctagacactcaaataaaaaaattatgtaagaaagaccattagcacgacaagaaggtttcaaagcccatgaggtaggagttaggaggaggaagaatgcacacacattgttttaggggaaggattggcacaggtagttttatgggtgaggaggaatttaaatcacgtgtatgcttagccagctaatcaactatgaatgcattagaggtagtggcacagagatgaacaatgtaaaccatgtttgaaatagcttgatggcaagtggaatacaggtggaatcatgcggcataaacttgaagggaatctttgggaccaaattatgggaaatattaattctaaggtaaaaaaaaggcaaaataatggaggaacaaagggaagcaaaaagaaacaggagaataactggcctattaaacagaaatttttgttctctagtaggaagttaaataagacaaactgaagtcaactggtgaccaagcacatggagaaggcagcatgggtgcaggagacgctgaagaacacgataatagaactttacagccggctgatctgagcttgagaaaaggaggtgcctttgggtttgggacatggaaagatagtgatgtctttagagaaacagaagttgggtgggctgtgagggtgaggaggattctgggtgttgagtatgttcctagggacactgatgggctgtttggagaattcctacgaggaagggctgttgatattcatgttctctttgctatggcaagaagcaggagagaaaacttaaagttgggggtgattattgcgtatggttgagacggaggaataagtagctgaactcatcacaactttgaagcaatatttataaactctgaagtagagtgagctgagctcagattcatgttgctgcatttattttaattattactaaatataggcaatttgccaaatgctttctgtgcatggtcttatttaatctttattacgtaatggctattattgtacccacttcacaataaagaaactgagacctaaagaatttaagcagttggccccaaaacagagtcagtattgagaaaagcagttttcaaactcaatttcttgactctaagtttcttattctttctataccacttcaatagtctcaaccaaccttatgtataactgactaaagaacaaagctttgcttcaagtacatgtcgtgggcacctgcgtgatgaaacctacacactttactctttgttgaatttacttcctgtgtatttaccgagaaaacagactatcttcttttaaaaagatgcacagactctgctttgaaagcctggtttgatgaaataaaagatatttagagtaagactcttactcacttactacgtatgtaacttggaaaaagttaacatctctggaggtagtctttttcttcagtggagataataatacgtattttatagtattttgaaaagaaatggaggaatataccaatcattttctcacctgcgttaatccatttgctgttactataacagaataccagagactgggtagtttataaaggaaagaggttcatttagtttagaattctggaggctaggaagtcctagatttggtggctgcctctggtcggcttctggtgagggcctagtgctgctggatagcctggcagaagcacagacatatgagtgcaagctaaaagagacaagcacaaggggtcaagcttgctatgtaacaacccactttaatgagaactagccaagttccctgagaactaacccagtctctaaagaatagcattaatccattcatgggggaagagtctccatgacccaaacacttcccacttagtcctatgtcccagtgctaccacattgaggaattgaggttctgatacctgaacttcggggggacacgctcaaaccgtagcaccacttgagcatgctatgctttctctttcccccgctgtaaagttctttcccaagaaaaacacatgactagttccttcagttctctgctctactgtcccctcttcagagaggtctccagcatcgattgtaattattcatagaagaagaagaacacctggatgttagctgacaacatgcctacataggaataagactgttttccagctttccctacagctacatgtggccgaagagttatagtaagaagagatgtccacaatgtcagggatatgaatttgcaaggagggacatccctgattcttccctttctttcttccttttactttatacagagctgatggctagagatggctagagatgaagcagccatcttgagccacgaggaaatcttagcaatggagacctgtgaagcggagcaataacacagaatgagccaaatgaatgctttttctactctggctgcctgacttcagactttaaacattaacatccttactatttggggctttctgtcactgtacatgaatctgaacagactaatattccctgtgacatattaaatatagcattaatttatgtacttagaggttattgtctatctctgcccagtagcatgtaaactttctgagggtaaaaccttttcttctgtttacttctgtatccttaccatttgaaatagtgccaggtacataaatgtgctcaacgtatttgttgaacaaatgaatgaatgtattaataatgaatgtaaaattcctagtacatggcagctttttgcttaacgggaattcctttcagaatgctgcaactagactgtaaaagacgaatcagatgaggccactcaagcattcagcttctgcctagcttaatgaacaacaaccactaacaagaacaataactgacccctttgatggagacttttactctgatgccatttatctttagacagggtgaagcctgctttctctcaaaacagtctgcattattcatgactagtttgctgcttttcgaaactggactctgtctgcctttggcatctccactaacagaaactatcaggtgtacgattcagtcctaattgctgccatggccttggcaatattgtgctgtcaccttctctgctggacagccagacttagtgctggtgtacaccggcttgccaagaattaatgtgcattgcagacagcaaaaatatgccattccagaatccaactgtacactatgggattatgatttcctattgtaaatatagcctaggcacaagaaaacatagcctaaccaaggaaatggatttctttattccaggtttaaaatgtatcaggattgggatttgggagaagcttttcttactctgagttcaaactatgagcataaaatgcgtgtgtgagtgtgtatttttaaatgcaccagcccacaacatttgtttcatagttatcttacaaattttattttttcattccatttttataaaagaacaaaaaaaattcctaaagcatcagttacattttggcaaaaaaaaaaaaaaaaaaaaaagctgcaaagtccaaaaaaactcagtggcttaaaaaatcatttgccctcaagagcctgcaggttttatggagatgggctggcctgggctggatttgtgcacctgtcccttgtcatcctgggattggtgtctggaatgttgaggcaccagaatggacaggccaaactgcacaaggatgaaccaagcctctggtcacatcaccactactaatgtccttttagccaaatcaagtcacgtggctagcccaaagtaaaagggtaggaaggtagtcccacccatagtggaagaacaccacgtatagctacatggcaaaggacacagatgtaggaatgagaagaattggggcaatatttacaatctgctacaacctccaaacattttcaccaatttttaaaattattattatctatttcttggtctattttgttctacttttccttttaggagagtttcctagatttaaaatttttatgtgttttgaaaatcttttttgtttttggattactactctaaatattttatataatatcctgtcagtatttcaaggataaaatgtcttttattaatttttaaaaaattttagttttaggggtataggtgtggatttcttatataggtaaatttcatgtcatgggggtttggtgtacacgttatttcatcacccaggcaatgcaaatagcatcctataggtagtttctcaatcctcactctcctcccatcctccaccctcaagtaggctccagtgtctattgttcctttctttgttttcatgcatactcgttgtttaactcccacatataagtgtgaacatgtggtatgtggttttctgtttctgcattagttcagttaggttaatgggccccagctccatccatgttgctgcagaagacacgatcttgttcttttttacgactgcacagtattccatggtatatatgtaccacattttctttatttagctgatggtcatttaggttgattccatgtctttgctaccatgaataccttctgcaaaaaacatatacatgcatgtgtctttatggtgaaatgatttgtattcctttgggtatatacccaataatgggattactaggttgaatggtagctctgttttaagtttttgagaagtcaccaaactgctttccacagtggctgaactaatttacattcccaccaacagtggataggcattcccatttctccacagccttgccagcatctgttttttttttttctttttaataatagccatcctgactcgtgtgaaatagtatttcactgtgggtttgatttgcacttctctgttgattagtgatgatgagtatttttttcatatgtttgttggctgcttatagatcttcttttgagaagtgtctcttcttgtcttttgcccatttttttaatggggttatttgttttttgcttgttaagttccttatagattctgtatattagacctttgttgggtgcatagtttggaaatattttctctcattctgtgggttgtctttttatttttaactctgttgatagtttcttttgctttgcaaaagcccttcagtttacttaggtctcacttgtcagtttttatttttgttggaattgcttttgaggacttagtcataaattctttgtcaaggctgatgtccagaatgatatttcctagattttcttctatgatttttttagtttgtagtgttatatttaagtctttaatccattttaatttttatacatggtgaaagatgggggtccagtttcattcttttgcatgtggctagcctcttatcccagcactatttattaaataggtagtcctttccccattgtttatttttgtcagctttgctaaagattagatagttgtaggtgtacaattttatttctggattctgtattcttttccattggtctatgtgtctgtttttgtaccagtaccatgatgttttggttattgtagccttatagcatagtttgaattcagataatgtaatggctccagctttgttcttttttattaagattgctttaactattggagctttttctttctttttgtttttttggttccatatgagttttagaatagtttttttttaattctatgaataatgatattggaattttgataggaattacattgaatctgtagattgcttttagaaatgtggtcatttttatggtgttgattcttctaatccataagcatgggatgtatttccatttatttgtgccatatatgatttctttcattagcatttgtaattttctttgtagagatccttcacttccctggctaagtatattcctaggtattttgtgtttttgcagctttgtgaagggaattgagttcttgatttgattctcagcttggttgttgttagtgtatagcagtgctactgatttgtgcacattgattttgtaaactgagactttactgaattcatttatcaagtccaggagtcttctggaggagtctttagtgttttctagttacacattcatatcattggcaaacagagatagatttacttcctcttttctgatttgaatgctctttacttttttctcttgcctgattgctttggctaggacttctggctgcctaagtctctgtaggtctagaagtacttgttttatgagtctgggtgctctttggccatttttatattggtttatttgtctttattattgagttgagatctatatctatatctatcttctggatgccaatttcttatcagttgaatttttcccattttatgggctgtcttttcacactttgggtattgcccttgaaagcacaaacatgtttaattttgatgatacttaattaatctttttttcttttgttgtttgtggttttcgtgtcatatccaaggattcattgccaaatccgaggtcatgaagatttacccccagatttttttctaaatgttttatagttttagcacttacatttaagtcttcgattcatctttagtaattcttttttgtattaactgtgtgtgaggtagggtcccaacttcatttatttgcatgtggtactcacaataggatatacctgtagatcagtgaaatagaattaagagtccaggagtaaaccctgggctttatggtcaactgatttttgcaagggtgctaagaacatttgatgttgaaaagactattcagacatttggtgtatgtgcttggctgaggagccaatggggtggataggattttcaaatcgtgttttcaataagtagtgctaggagaactggacagtcacatgcaaaagtatgaagctgggcccctacctctcacacagttaatacaaaaaaattactgaaggtgaatgaatgacttaaatgtaaatgctaaaactgtaaaactcttagaagaaaacatagggataaatcttcatgaccttgaaactgtcagtggattctcagatatgacaccaaaaacacaacaaacaacaaaagacaaaaagtaaattaattgtcatcaacattaaacatgtttatgctttaaatgacactatcaaaagtgtgaaaagataacagaataggaaaaatttacctgataagaaattggcatccagaagatagatagctgtagatatatatctcaactcaataataaaaagataaataaacaaatatggaatgaccaaaggcactcaaattcataaaacaagtacttctagaactatgaaaagacttaggcagccacataataatactgggggacttcaacaccccactgacagcattagacagataattgaggcagaaagctaacaaagaaattctagacttaactttgacacttgacaaattggacctaataggcatccacagactactttacccatcaaccacagaatgtacattattctcatctgctcatgaaacatactctcaaatcaaccacatgctcagccataaagccagtctcaataaattcaaaaaattgaaatcttgaaccacaatggaatataaaaaataaaaattaggctgggtgcggtagctcacccctgtaatcccagcattttcggaggccaaggtggatggatctcttgaggcaaggagtttgagaccagcctggccaacgtggtgaaactctttctctactaaaaaaaaaaaaaaaaatacaaaaattagctaggtgtggtggcacgcacctataatcccagctacttgggaggttgaggcaggagaatcaccttaacctgggagacagaaattgcagtgagccaagattgcactgctgcactccactctgggtgacagagtgagtgagacacttctctttcatagataggtagatagatacatagatagatagatacatagatagatagatagatagatagatagatagatagatagatagatagatgacagagagatgtaaataaaataaaaatcaataccaagatttctcaaaaccacacaattacatggaaattaaacaacttgctcctgaatgacttctgggtaaacaaaaaaattaatgacttttgaatgataaacaaactgcatttctagaataaatctcacttgatcatgatgtataatttttttcaatattattggatttaattttctagtattgtgttgaggatttttgtgttcatattcttaagagacattggtctgtaatgttcctttcttttgagattgcgtgtgtgtgatgtctttggttttggtattgtggtaacactggcctcaaagagtgaggtggaaagtgttcctccacttctattttttaaacacgtttgtgaaaaattggtattatttcttaaaacatttggtttaccagtaaaaccatcaaggatggcttgtttttgtaaggtcagcagtaatgctttctctttcatttctgatactagtaatttgaatcatctctctttttttcttggtcaattatgctaaatatttatcacatttgttgattttttttcatagccatattccatatggcattccaaacttccacaatcaactttagtttcatttttctctattgtttttatattcttgattttatcaatgtccactccaactttattatttcctgtcttcttgctttaggtttagtttgcttttctttttccagtttcttaaggtatacagttgagtattattttgtaatttttcttacatgttaatggaagtattattactataaatgtttctccaagcactgctttagctacgtctcataagctttggaatgttgtcccttcattttcattcatctcaaagtattttataaagtaacttgggattgcttctgcctcgttgttttacccacacgcagctggtaagattcactcattgctgtattgttttcaacaatatcatgggcataaattgttctacatataaatctcataaaatttaggctgtgttaaaggactccttcctgagatcagtgtttgagatttgttttaatcacaaatttgccactgggagggctccttccagtggtctccctggttctctctggtaaattagacagcctgtagtttagcctgtatctccgatgaatctatcaatctcccaattgcctttcaccacaggttccagttattaagaacacccttatggttgaacttctccacattttgttgccaaaaaaaaaaaaaaaaaacctaaaaactaaaacaacaaaacagtccctttggggatagattagcagttatctgtttatggcttgcttctttagaggcaaggaaacatatatgagccacatttctggagctagaaatgggagcaacatcatgtttctttctgaatgaccctcccactttaggagctgaacactcatgggagagggaggacagtgacctcagattctctcagcttgcttctcccatgtggaaaccccacaccatgatatgaggcaagaacaagggggaccccaatattctcggcaatgctgttcttaatttaaagcctctgtctaatgagcctttgtctaatgaggtagagctgggtaaaaaaagggcaccatcacctctcatctgtactcactggcagcttaacctcatgaacatgtagctggggccagaatgagaggggaagacagctcacttacagagagctaaggtgggagagagccctgtgttcttggatgcagcaggctggagtggagtttccatttccctgagctgggaggtagcagaagagtagatcttgttttaaatgccacagactattactgttcttactcagttttagtagactttcttgaataactatattttttatcttgctgtatacagaaaaatagcattttggagactttactgttttttaaaaaatagttttcagcagtcttactgggaaatgagtctgcagaactcctcatactgtcctgatggaagccttggctaaatgctttcaaagacatctatttatatctatttcatgctggtattgtacctgcacctaaagtgactgtgcccgtaaaatagggagtctagttctattgtttttgagtccaattttaacatccatattgactttttacagcccctgctttcttctcattattgtaaatatttatagtattaattttattgtgtacagaggcatatttgaatgattaaaaggcaagcaccagccttttgagaagactttatcaatcactctagcacaactgttcacaaagcaaggagtcagccgcctcccatataggcatcccccaaccataacgtggagaagcagatcccagttagtactttctatgttatagctcctctagtttgtaattagtgtttgaaaggatccagagtaacatggaaaagattcactgtcttgattcactttcataactcagctgtcacttgggtctttcctgcccatgggagatttaggaaaatgtgcctgatttcatgccagggagtccaggacccttgtctcaagggttctatgaactcctggtgagtcagaggcctgtgtgccctgccctgtttttgagcctgtgcagtcctgcctgggcatgtgctccagtgcctggggagccagccacattatcacccccgccaccatacacccaaatgtatcaataattccatgaatttagtaattttccaacatttttgaatgtgggcctgaagagagaagtaattgtgaatccctgggctgtccgtccacctggcccctccctgcatcctcagctgtttcccctcttgtgcccctggctgccagggtgctgtcattactcaggcatccagttggaaagttccaggcacatttcggcccagagtcacttacccagagcctggcttatcaaagccttttcttaacaatgggagggaggttgaatcttaaagcaattcttctctgttaaggcaattatgcattttttcttattattacattatttatttaagggctgtattacatgggatctgactggagacgatagaggttatttgcaaagcctttgaaaatgaactcagaagaagtttaatccactctcccaagggaaccatgtccctacaaaaacttaaaactgcagcaaaacagaatagagagggtttgcttgtgtgcctgcagcagagcacccccttccttatgtaaacacttacaaagctgccatctttgcacagatggtggctgagtggggtgctggctttgaaggctccctgttttaatactggtgttttcctcctcaggtctcacgcacgaagtactgtaagcttctctatgggcagcactcatcaagccagaaagtagcttgccatggcttcttctatggggtgttttctttattatgttcataaagcaaaaaaaaaaaaaaaaaaaaaaaaacagagagagaaagaaaagaaaatcagaagacaatgactactttagctctcttggcctctcaaggtgactggtgtgagaatagcttggtggctaaggacagaaaaaaaaatcttttgtttatctagactctagggtatttctgaaatgaagggaaatgttcagagaccattaaaaatgcaagaggccacataaggggctgagtcatatagctgtcacctcaccaccttggaaacaaaacgctctatcatgtttgtttagctggtgacaatgatataatgctggagatgaggctatgtatttttttttatcccactgacttggctattgttccttactttaaaatgatcccctttggttactctaaagaacaaaggaaaaaaacaatagatatgcattttgctgtttagttaagaaggaaatattgttttcattacaccaaagtctgacaaggaatttaattcactcattactccattaaatatgaactgggcatctgcaggggtgttagagtcagtggcagaagggtttatgtgtcctgtattcttggagctctactgtaacaactgatggcattgaaggatgcaccatacacctgcatgtacacaggaagggctttcacagccagaatagggccttgcacaagtgagcactgaattagtactgaatggatggaggaaaggagatctggttgtgggtagcatgaaggatactcttagatgcgaagtcagagaggaaggcactcgttacatcatggagagcctcatggacaagctgaagagtttgatattgagtcagagtctttcagacatgaagctgacatggcctccggagttctgagacagttctgttggcctttcctggaggtgacgttgacccaaccactttaatttggatctatgaatggtggagtcatttaagaaagtgacacatccagccacagagagcagtgtttatggagtgatgtgtattaacatgaatcaagcttcttttttattgtgaagctgtcatgtccctatacgatctcgtctttaaactcagaagtgtattgaggctgttttcaaagaggttttcttctccaggaggaatgtgagtgccagctgccaaacactgttttgttgttgttgttatttgtcaaaggctctctttatgttaataccttgggtctgtaatcctcacagccattctgatttgcatatgcaatgattggaaaatgatccaaatcaaacttaactgaagttgaaataataaaggtgcttgcagtgaagggacatggttgtgaggtaagccccatggtctcagctctgctagttaataagctgagtgacaaagaaaaaatctcctgatctctttgggcctcaaatttttgcattttatagagaggaattggtatccattctagtccatgtacaggtgtgataagagtaaaatgaaattattgatgtgaaagtattaatataaaggatataagagcattaacgattagatgagatcctgcttcaggctggagttttgaggttaattactcagctggaactgtaactccctccattcccttggagttgtgtgacccaaacaagttatgtagcttctctgagatccacctcgcttctgtaaatcagaggcagagatagcagcatcagtattttgtggggattaattgggataatgtgtttggtgcctcactcacagaggatacaggacagagctcatgtcctcagtcttctcttttggtttccttttctttccagtgggtaatcatgaggactgagattacaatgaggaagtttctattaataatacagagatgccagctacacatcaagtgctcacataaatgtttgcatcccgctgtttgctcagccacccttcctcagtgccatcctctcctcctcttcatgcatccaaaggaaacctattacaattcagtagctgaggacagatcactggaatttggtactttgttgaggcaccaacccatgaggagtggggtgtggtgtggtaaggcaggaagatgagaattagggaccaatgtagtctgaggcagcggggaccccatattccacagtcagtgctgtaacacttgtgctggatgagagcttaacgtgagaccacgggaggcctggtccccctccgctctctgctcttgccctgtggtggatgagggagaagtcatctttaaaggtatttcctactcagatatgtgtagggaatagcacatgtatggggttgtggatgtgagtgtgaatagactcctcgtggggcagatgatggaaatcagtgggcatatatctataaacacataatacaaatattacatattttacaaatcctgttattttctaaagtctaagattagtttctataccaagaagaattttatgcgtttaatttttagaggcaatgtgacaaaaagttcctaaataaatgatttttaaaatcagaaactgaaatacagtcgtagagtatgagacattagtatgttcctttaattctcttagaagccatgtatattttttctttctaatgataaagttttatgtgctcattattttagaattcaaaatagtataaagaataaaacctaatggttatgcgattatttcttgtccggataacattccagaatttatttcagtctgactgtaaatatgtgcaaacatacttacatcattaatgtaatactgagtctatgattttctattttgcacttaatattatataatagccattttctcttcattaaatattatttgtagagatttttaatagttgaggctgaaatcaatgtatttgttataaattatgacttttaatttggggggaaggacttttataaggggagccttaagctcaggaatgcaaagcttcataggcacttggtataacttgacaagtgatttttcagaaatgtctctgcaggtgcattgccacctcttttgttctgctcttgaagtgtctgactttcaaaatatatgtgtgtatgttttttcttcctctcatgtattattcctgcttctgttttagcattaattaatatattacatttaatgtttgtggttccaaaatgttgtacctcaaaaaattgtagaatatttcttgtaagcacctttacctacagataatgccatttatttatctctatttaatcaccgattatacaaataatgtggacataacgtattatctagaaatgttagatcaatgagtgaacatagaaataaatgactccttggctattttgcaacattttattctgtggaagtatgaaaatcaaataaatccttcagggaatttagattattgacataactgtgtatgttatagatagaaatgaaaaagtcaagctaatattaattagatatttacatcataatgaatttaataatcttcgaagagtgtctaaattgttgaaggtgccatgcttttataattttacgtttagaagtcttcttaactattaactgttctagagagatcctgagtaacctatttcaacctatctcctatctgtttcaggcatattttctctagagtgtttctattttggaagactggtagaatttactttttgtttaatttctgtgtaatttttcttttttcgtaattcatgttcttcacagtaaagttggaattcttttagttcaaacgaaattttaatttgaaagaattttaattattaatgtgcatatgtgcttatagagaatttattagataattactggaatttagcatgaatttttcaaaagtcattagcaaaatatacttaaagggctgcagtttctactaatggtaaaaatggatcctaatatgcataagaacatacagccatctctgtgccactgtctcctcataccattgtatttttatataatgcttcctattcatgtttgaattgttttatctgcttttatctaagttctccaaataaatagtggccttcttcactccaagaagaacattcttctgttctggtcatattctgaatagatcctaaatttcactgcttatttatctacttagttacacagtgccagacattgttccaagtaatttgcaaggattaattcagtcagtcctctcacaaccttattaggcagatactataattaatctatttgctagatgaggcaactgaggttagaaaatttaccagactttccagggtcaaacaactggtacgtggaggagctggattcagtagtgcaaacactacattttgtcatgccatcagaatcattaataaacatgagaccagaaacacatctccatgcaacacatcccctctgccctggaacataatgttatgcccagacacagctgagagctctcccaggagcatttacaaagctccagtgacatggtgcttcaccttgggaagccccttcaaccacctaggcctcaatcccttcttttcatgaaacgtggacatatagacccactttgggggatttggtgaagacacaatgggttgatcgtgttattcagcagcatagcttgtaacatactgctgagaagggggatggccacagaatatatacctcttgtaccaacccaatgtgttggcctttaacaattctgagagatagccaaatagaaatgttagagaggtgcatgtccgtatgcttttatgtatattttgtcagtgtcctcaccaacctctcagccatgtgaagattagaaaccattaactcgaatgatgggaggctactgtggccatgcacagacctcagagggaagtgacatctgacagcctgaaattaagacaagaggacagaaaaacagaacaccagggcaaagagctccatgggtgctcacaagggtgatctatgtcactgaaacaaggtcacattgtcttgggtcccctgtctttaccagacagacttgaaaaataatttgaccataaatctgttagggatcagcctcatttaggggaaatttacttaagtgtaacacattttcccccagcaatgctttgtaaatgagatgagtatgattgctaagactgggcatgccatttcattcattaaactaatatttaccagtgctaggtactaggtactcatactgtgcttggtacttagaaaagatgcttcagtgaacaaaatggacagagattttagtcatcagagtatattcatgtatttctgattttttttgggatgctatgatgtgcccaacaccacctgagataagggagtagaataattcatatagtttttggaggacccctacattcctggagattgctatttgaggttaccttagggtatgagtatgagctcatgtcttgctgatgggacaccagtggaactactgtctataactctacaatgtgaggaacagagccccttaggcaggagacttcctttgcagtcatagggcctgtccacctaggctgggttgaagtacaattgggataacttttttatataacaaacaaacaagtgcctggtaattacatatgcaatccctttcatcttttcccagccaaattttaatcagtacagaccttgaagcaataaggccagcaatcatgcttcccagggccagtttccagcccagcttcccacttccactagctcaggactttgctttcaccgtttgcattttcaccttccctcttttattgactgggtgttgattctgggacttgctgataatttttttaaggtaattcagtgtctgtgtcaatataaatggaaaacaactaactgtataattgacttacaattaatttctgtgtcttatattgagaatccaaactcccaacaatttggagtaattacttcctttttctccctctgtgtgaaaatggacttagaatttactcatcttaggtcaatatgataataatcatgtttctattttatttaactctcaggtttggtgatggttatacagtcaaagtttggctctgtaaggaagcaaatcaacattgcactgtttctgaccacttgaagctttattttccaggaattcagttcaaggtagtgctaatatcttgtattatttctttgttttcagctaaaaaaaaataataaatgtacctgtctttttttgtttttattctatgctgttataagatactacttgttaccttagccacattgcaaagtataggccctgcctccctaccaaaaatagcatggatagctgatattgcttgaccactctgaagagtgacaagcctgcttaattgcttcctggattggccagagcagcctgtgattacatatcacgcctcttatctgtgggcacaggtccattgcataactcatcttgttcagcatagaagattgcaaaagctaatctcttccatatatttgctgtagggtttataggcttgatggtttcagcattgcttcacagaaatagccctatgcttgagatcacaatcctctataaacttgctgtcatcaagtatggtcactgaaccagcagcatcttcattgcctgggacctgttagacatgcagaatcacaggccccaacctattgaatgggaatctgcattttaacaaggtgacccggagattcctatgaacactgaagtttgagaagcactgtctaaaaatctcttggataactgtgggatgctagtttattataacttctaggaggctgtagtccataaagtagttatgttctatttatttcaacaactgtcatttagtgaaatcctactatgcaagaagcatgctgtgtgagactgtcattcatgctcaattatgactctgagtcaccctataaaacagacataattatctccattggcatacatgaagacaaggatcagaggtttaaatatcttcccaagtgttgctcagctaatgatgagaatagtgagagataagcccaagtcccagtgtaaaactcagggcccttccatccgtctctgttaggccatgttaaattcctacatttcaaatatctttgggcatcttatgattccttaaacagggcttccccatgctgttgcaaggttagagcatatcagggggcagaacagcaatgccactcagttgaacgttgtttgtcaaatataccccatgaaaaattgtcatcaataagcattcattggagactcacaaaattaagtgtaggttgagaaaacgtaactgaatttttttgccaattaaatgtagtatgatcaattttgtttaataatgctagttatatgatactttttttttttttttttttgcttttagggacagcacctgaatttattagaatatcatgtgccaaaaagatggggatgcctagctgacttgttcaaagttatagagaacaataaaaccttcttgaatattaagcattattccattaaccaaaccactttggagcaggtatagtatcttgaatgattcaggaggttgaattttggtctgttcatcagacctaatgtagccaattttaaaattaatcgaattgcttcaattcaccactttattcaattcatcttgttaaattttataaaattatgataaggatggtgagtgtcagaaagtttgtttactgtatacccttctacttaagatagatattcagtagagtttcaatttgttcatattattttgggcatttaactaattaaatcatgtcacgttaaccttcctatctccaccttactcagccccacaagacttttcgggggggcttcactgtaatcaaatgatagctaacttctggggaaacaaaaagcgtttcatttactaagagtaccaggaatataaaaatacatcacgacatatttctaaaaccaggcttaaggtattgagaacttctaggtgatttattattataattgtctagaaatatgaatgttcttagagttgtgtcctcaatggatttatatatttatgtgatttgggagggaatggtatgaattaatgatctgtggtttttagggcaagttggccagtgttctgagacaatgtctcctttctaataagtgagaccaaagggttgtattcttataagtaaacaacatttttatggtttttttcaggtatttattaattttgcttctgagcagcagcaaactctacaatctactcttgatccatccactgacagtcaccacacacatcacttgcccatctgagcactaaagaagtttccataaggaataaaaccttgtcttccattacaattaacagtcaaggataaaacaagcacgcgcacaatcaaggagctggaacacactctccaggccgtcaaattattctcttgttcattttctattttgaatctccttgttagttaataaccaccaaatggaaaggtcattctttctgcagacttttggggagctcctccaaaacatttgttctctttaccatgccagatggacaccagcttctttgtgacaaaggcatgaatgatttgacagtgtccaaactgagacattctggagctggaaagcctgtcacactagagtgtgtgtgacatgtccactctaaacatgtcacttttctgttaagaaaactgagccccctccccacaggttaaaaaactttagtaacttgtttgtatagaaaatagtaacaaggactattttctattgttgtcatctatttactagatacatgtttttaatgattttaatgtaagcttttattaatactgatgacattatatggtatgatatgaaaaaatcaccaattttttacatataaaagatacctttttaaaaaaataggttttaagagctcttttagtatacactttagcaaaattaattaaattgaactagttactctgtatcaattacagtagttctaccagaatctcccaggttataatttatgagggtagagaaataaaatgtagatgcattttctttttcttcatttggatgaataattactgttttttgttattctaagtcagtgtttttcaaagcgtagtggtccccatattagctgcattgccatcttctgggagcttgcaagaaatgtacattctcaggatccactccagacctattgaatctcaaattctggggcttaaacaagcacattccaagttaagaaccaatgacctaagggaatgtctggttacctcctagttatacaagcaaaatctgcatagtatgtagtcttttttatttatttattttttttttttgaggcggagtctcgctctgtcacccaggctggagtgcagtggcgcgatgtcggctcactgcaagctccgcctcctgggttcacgccattctcctgcctcagcctccccagcagctgggactacaggcacacatcgccacacccggctaatttttagtatttttagtagagacggggtttcaccgtgttagccaggatggtctctatctcctgaccttgtgatccgcccccctccacctcccaaagtgctgggattacaggcgtgagccaccgtgtccggccgtagtttattttaaaatatatttttaaaagctttgtaaaaattatgtcattctcagaattgttgtcttcaaagcattgtcagatgtagagtgctcagatgtggctcttaaagactatatacatctgaatttttcatcctatagttagtaagatgcataaaatcaatccactactgaaatagtttccagtcagacatttctgagttcagacatttctcaacattcttttaacaacatttttctgaatcctcaatagaaaatcacattaatcttattttaaaatttggcctttttcaacactaacgttgagtaccggtagcttgtgatcaaaggcatatacttccttatgagatttctttactaaagcaagatttcattaaatctctatttcctaaatatcattctatacaaaagatattttttaaacggtaaggattaagacaatcactgatagctttgttgtgagcaattttgattcccatgtatcacatgaattacacttccttaaataaattacagtttatggctgtatgatttattctctaattctaacatagtctagttgtcaaaaggaaatatgtaatctttttatgattgttgaatcaataaataccaatttgtgaaacatgaatgtgtttaaactgcagtgaataaatgagatgtgctttaatttaacccgatttttggaatgtaattgtgcttttgccaatatattttcttgtatctttatttgtgtctttagggatccaatttaatttaagtaagcaggaaatgaagctactccaaatcttttaaagtttgaaaggttaaaatttaattgagttttgctctgctgtattctgctcttaggggttcttttctggtttttgaactgctgtattcttgaagtttatgcttcaaggtatgcctttgaacaataaacagaaagaaagagaaacccaacatgctaaaacaccacatcccagaagactggatacaaaaggtcaaatcttatgttaatgttgaaaatgtcattgcatttataagtcatgcaggtatttaacgcctttggagttaaacatttgtcttaagacctttgggcttaaggtcacacaactgagacttttaaacagactaccttcttttgaaatcattctgagtagagtactttatgaaacagaaataatagtgattatcccagttctagtaatctagcatttactatatagattatctttactcagatatttaaacagttgatgtatgaaaactttcatgcaaaatcaagatagtaaaaagcaaacagaaagtgtattttagcatagtaaagactaggtggcttaaggtcataggtagtttatttaataagcattgaattgaaaaatagctcaacatgacatcttacaaaacatcttagaaaatacacagccacatacataccccacaacctccccccataggcacactattagtgttaatgagaatgacatgaatattagcataatcacaaatgtttctgcctaagtaggagttacagacactttaaattttcaaactgggttaactatgtttctcctttggcttttgctttggcctgctgcattatttcagctcagtggatttttttgatgacttgttacaactcaatttcacacacttgaataattcaaagccctttcacacatacacacagacatacatatgcacacatgcacatacaagcatacatactcacacatgcacatgtatgcacactcaaacacacattcattccttcaactaacacctttgatctcattccatgcacataagtaggtagtgggtactataaacatggggtggtggactaatcaatagcagagccacaatcattgtccttgaggagcacttaagcaggtggagatggcaagatgagatctacaagcaaggagtactccctgacatggggtcggaatgattcactctcatggaggatgtgggaacaaatctcgtgagatagttaccacctgcttgggcctttgcagattgagaatgggggaaatgacatctgaggctatgaatatcagagcaaatggaaaatatttaatgagcaatggatgcttgcttattatgttggagaacgatagctaatatagtggtttctgtagacatcaagaacccaggtgtctcatttttagaatttctcttacattccagaatggccgctagatctctagctatcacaatattcaaagatgaaataaaagaaaaattggactaaggggataatagcacatctatttgaagagcttccctggcaacctcacctgcatacttaggcttatattacatcacctggaagtattcacatgacgctaactagctacaagagtgtttggtcaatgcagtctttatccaggcttctgaccaccctaaaataaaatgaaggttttgattctatgtgagaagaactaaacagatactggatagataaccagcagtcactactaaagaaacagagaagttttgtggccattttgcttgggaaaagaatgcattcaattttggacatgttgaatgaaccaggtagtgttaaattatgtggctattttgggcaatctaggttctaagagtgttactattttcaagattaaagatgtatgctaagatctgtggagcggatatcatttatatttataaacattactgtcaaattgaatgtggtagataaagagaagaaaattttatggatatttcccatttgggttaaataaatagcattgtcattttctcacagtgagaattcctcttgagaactttaataaataaatgtctcttgctggaaagggttgcaaattacagaaagaagtcagaagcatttttcttaattatttgctattgcttgccatcacaagagacatttcattgtctttcactgtaagtgaatctatcacattttttctcttttgttaaagtgttttaaagaaacactctacattaaaatgttttaaagaaaaattaggtccactgagttaaaggtacatcttaaacctagcaaaactcaatggttaaaaagcacatctagaaattttatgagcatattcttctttccaatacaaggcaacattctgaaccccatattggccttcacatttatgttccatgggtgtggcttggtattgatggatgacaactgttgttggtggggttctgtttgttccttggttttgttcatgaaacactgaggactctttgcggggttcaatgcagggtgaggagtcattgcttccaatctgtttacacttgcacttagtgtcacattgcagctttttctacccgcacataaccaagtaaaaactttgtttgcctcagcataagtttaagtgaattagggtagtacgctagggcaaggcagcaagtccaagggggagttcataggctgggcatcaggagacctggctctactgccaatcagagtgggatctccaagcccttttgctgttgtgcccttccattttcctcacatttacaatcatgacaagatctttgagaagactaatgaaatcagcaaatttccacagacggtgcacaaatatacaattttagaaaagaaaagggagcatatctaaagatagaaatgaagagtaataagagaataatatgaaaaactttatgcaaaatattcaaaaacaaataatatttttagtaaacagttaggaatcaagattgtctcaagaaaacaatagccactccagaaaatgaatcaaccatgaaatatcatcacaagtatatccctaccagtgtcccatcccaatacagcagacccagatggttttacaaatgtgtcattctaaaagagataaattctctattttacacaagctacttcagaaaatgaacaaattctatctcattttagacaccagtataacattggcacacaaacttgtccaagaataaaagaaaagacaaatatggagaaattaatgtatgaacatggattcagacagaactaatgataaatagaatcagtagtatatttctcataatacaatgtgatttatctagaaaatgcggttgtgatgtaaactcagaaactattaatgtaatccattccattcaaaggtaataaatgctctcaaatgcagaaaaaatatttcataaaatatgataatctatattagaaagttaaacttacaagtaagttttcacaatctgatatgatacagctaataatatttatgaagttttaaaagctgaattgtgctacactgtcaaaatatagcgtgcccttctcaggaaacgttatttattatttctcttctgtcttgtatattttatctctcttagagctaggttctttctagcaacacttaagatgtttcagtctctcccattgtataaaatactgtatcaatgccacatcagtgtccactcaataatccatccctccagcgtctgttccatcatcacctccgactgccttctctgcctgttctactctggctgctgctccctctatgccaccaaaacagtcccagctaagatcactgagggtctccattttcctaagtccaacagataattcaaaattcacaccttctcacctgtctgttaaaataccttttattccttggatctcatgactctatacttttctgtttttttttccccctctccttagtatcatttttaggcaaatgctccttcacatggcaataaactttgcttctgaatcattcttctcaaatctcaacttttatttttgcttcactctaccattgccctctggatttttgtagattccttttttattatttatttatttatttatttatttcagatggagtctcgctctttcgccaaggctggagtgcaatggcatggtctcagctcactgcaacctccacctcctgggttcaagcaattcttctacctcagcctcatgagtagctgggactacaggctcatgccaccatgcccagctatgttttgtattttagtagagacagggtttcactatgttggccaggctggtctcgaattcctgacctcaggcgatcctcccatctcagcctcccaaagtgctgggattacaggcataagccaccatgcccggcctagattcctcttttaatttttacaatttacccctttatcttccttctagtcttaggactcatattgtaattcaagagtgcaatgaacattgtctttggcactctcattactcttacataaatagcaactactccttttgttcttatgttattctgctctcttctgactgaaacacagtgacctaaattaagctaattatcagttaggtatgtgcagccctactttgtccagcaacagccagaacctgacttctgtttggtcttccaagttgctcttggtaattgggaaattttttgatgaaaaaaaaaatgcttttaccagtcagtaatagctgtgtgtccccactcaaaatttatgtattgaagtcctaacccacaaggtaataattttaggaagtgggggtgaagccctcatgaatggagttagggcccttgataaaaaggccccagagagacccctcagcctttccaccacatgaggacacagagagaaggcactgcctatggggaagcaggccctcaccagccgctgaacctgctggtgctttggtcttggacttcccagcctccaaaactgtgaggaaataaatatctgtggtttgtaagccacctggtttatggtattttctcatagcagcctaaattgcctaagacagtgtccatgcaaactaatttacacaacacaaaaaataatccaaatattgtgttcagaagtggaatggtctgtgtaatataaaaatcagattttgaggttagactgggtcttatatcttggtcctagagtttccgtaacaaagtaccacagcctggtggcttaataaaatcagaaactaattctcccacagctctagagggtagaagtccaaaattaaggtgttagcagggccatgctccctccaagacgctaggtggaatctttttttgcctcttcttgcttctgatggtggccatgcttgttttgcattccttgaccagaagacgcatcacttgagtctcgggctctgctgtcacatggtgctctccctgtatacatctatcttcacatcatgttctccttttcttaccaagatacaagtgatgctagattggggtccactgtgatggccttttcttaattaactctgcaaagactttccaaataagatcacatccactgcgactgagggttaggacttcaacatctatctttctggagaacacacttcaatccataatacactttgtcacttaagcatcttgaatttcaattttattaagctggggataataatgctgacttcacaatgtttctgtgaaatgaaatgggacagcaaatgtaaatgactgccatggtgactgactaatattaacattctgtttatcccctcacctccaagaaaaggtgtattcatgccttttccagttcctcccttttctctaccttcttcgctgctgcatgaggcatagatgacagttcaatagcccatatctcagatttgttttgtggccaaactgctgtttagttctaggtctgtttttctaaatatccactcggaatctccctttgaatgaccttaaggcctttaaactcattatccaaaatctaatcaatgcactttcttgccaaaccttaatccctttcgagcataactatcacactcataggactcagattgtaattcaacagtgcaatgaacattgtctttggtattttcattactcttctcacatccagtccactatgaagtcctgttaactttggctcgtatatctctctcaaacctttccctttatgtccatctccactgcaaacattctggttcaagtagactttacttcccacctggttgctgcctcctaggttttcgacctatgtacctgtagtggacaaaataatgacctcctgactgacaatccctagagcctgtgaatatggtaccttacataacaaaagggactttatagatgagattaagttaattgagatgggacaatagccacattatccaggtggcctcaaggtaatcacatgagttcttatctgggaaagagggaagctgtagaggcacagagaagagaggtgatgatggaagcagaggttggagtgatgagctttttagatggaggtaggggcaaggcaccaaggaatgctggtgcctttagaagctggaagggatgagaaagcccattatcctctggagcttccagaaggaggattcaggccaatatcttgatttaagcccagagaaatccatttccaacttctggcttccagactataggatcataaatgtctgtggctttaatccaccatgtccatggtaaattcttacagcagcaacgggaaactaatatgctactgtttgcctcttcctgtaccttctctatgcagacaaaataatgccatcttcgagagtcagatcttcttgaaaccaaaattagataatcttcctgacacattcttacatccctggtccacactcgtctgatccttgtgtagtaggatcaagccttccttacccttcacgttctctgcaccaaggtctcccatttcctggatctcactggctccttcctgctacaggaattttctcatgttgttccctgtcctcagaacagctgagcagccccatcatcacttcttataatactctcttaatatcatttatcttctctttttaacccttgtcatcattgccactgacattttacagttcttgttttttattttgtgtctctttttctacctgactttatgtttactcctccacagagtcggggacagggcctcgtttcctccctcttcctttacatcattgtgtccccatcctccagctcagtgcacttgtcactgtgggtactgaaacttatgagtttaggcaaggaatgcacagaagaaccccagcaatatccaggctagagcatgtttgtattgctgcctggactgttaatagcatctgtagctttgtaatgtatctacttgaataattctacattgacaatgtttctacccatctgaaataaataaattaacttgcatcatcttttcataagttcaggaaaggcatttcttatggagttatcatcatttgcatgtcagaataattttgaggcactgaagtcattgacaattcaatgtcggaagtgatagtgtttcaagcttttaaaaaatctgtaacggtacatatccaatgtgttctaaatctttatgtctcagaacagtaaattaatacagataaataaagctaaaaaaggaacagaattaagttccaatctgatgtggataaaagcataagataatgtttaattctctaccacattcagttataagccaaatagagtatcaacaatctggaaaagattaaataaaaggtttaaagcacatttttcagttcaaaaataggttattattttcaatgctcatggcacttacaattccttagaaatattctgtccctttttatgttacaagtgtgtgggagatggctgtttcacataagaataagcctggttcaggccctgttatgaagtgtttctcagtcagagaacccaaatccacaaaatcccactaatcctaatcacccagctaatccctttgagaagagagtggagacagggtggaaggtgaaggtgctgctcagggtatcagttacactttctgtgtttccagaaatgtggcctcctccaggagaaagaatttactgggcctctgggtgtggaagggaaactgggtgggatagggtggggcaaagcaatgggtgctcaacccaaacccttgtagaatctattccaaaatcttcaaattaaagaggaccaaagagaaaggctgtcatgattgacatgaagtcatctgagaagagtgcctattcagggcagcaagacggaggggcaggggcttgggttgtgttggagggagtagagggtttgctgctttgtgagcttgacctcaggcagaggacaattgctacatccatatgttcaggcatactatggtcccaccagtatctgcaggggttcttttaattcagtatgttgtgatgctaacaaaagggctagttaggaagggcctgcccagtgggatgaaggatgttgtctaggtggttgctacagttactggagcacaggttgagacaggcgtggtgagagttggagctgggcaggctggtaaggcatgatcaggaagggcctccagggccatgttttggagttgagacttcagtccaacaatgaattctatgggaccttcttccaggaggtttttttcctatggttcttgagcaaatgccttgtgcacaatctctcccaatacacattctagcttacaccctgttggtcaataggaaactgttgaggaaggttaacaatggagtaaaaatgtcctattttggacagacaaacctggtgttccacgagggtccagttggaattaaagagaaggggaaagacccagcatcctccaggtggctttggccatcatctgagtgacaatactggaggaccttagctagcacgggtgaatggggagagatttagaaagcaaaattggtagaggttcagcagagaaataaatatgtacatgtagcagagagatatggactgggagaagacatctggcaaatatagaaagctgtaacatcaaaactgtgaaaagactgacattcattaaacatgaagtgtggagaaagaagaaaacacacaaatgctaaggagaataaaatgccaaagaacaaagggagatgagcccttgttgaaaagtgagaatgaagcagaggtagaggaaagtcagagaaggataaagaatcaggagaaatgggaggaaagggtttcaccaagggagatggcaaaatgtcactataagcagcctgctagagcaagcctctcttccagaccacagttatccttccttacaacttctcccttttcaagccgctggctgagagttttggttacttctgtggatttcttctatcagatatgctgcctcctggcctgcatcacctcggtccttatcaatgggattggtaatgtattgttcctctcatctcttgttttgggtggacatctctattccacttcctagatatggccagtatcctttctccttcccacacccatcactttgcagtcaatatctaagatggataaggcccattattctgagaacatctatcatttgtttaatgagccttgtctgagccatttactctctgggtctaaaaaatatgttggaaaggaggaaaatgcagccactactgctcagaggtgacttcactaccacccaatggactgcttaggagtaggttggcaggtaccagaggcactggccctacactctgctctggaagattgaagccagagagcagaatctcccaggttcacttttggcagcaagtaaacggtgtcatgtgacaggttttccaggaagtttgcatgggtcactttacattgttgtctcctagcaatagattgatggtggtcacactttctgtgtatctagattatgccctcttgggtgtgatgtgtgtctcctggcagtgacatacagaggagttttcccacttctccaaggaatagagagtcactgagaccatttgacatctggagtggagcaaaggaactttgcaagcctcgttcaagagaagggtgagggagcttgtatgtccaacctttttatcctctctggaccacttctttgcatctgtgctgcattttctgatccagcaatgttctctttgaagatgagataggagtagggacccatgctccttgctgccagcacttgacccagctggcacaggtagagcaggactagtctcaagtaggaaagctggttccatattgtggtgagactaggggagtggcagaaagtgctttagcctcacatctaccctagctaagctctggaatgctctccacttttaagcgatgcaagggacaaaagacgtttctcttaggatggctatctcctctggccagctccgaatgcctatccctcatgatggttacatccaggtaaggtatggagaggaaaacacagtctcagagtttaaagtgaggtttcattattggtaatgatttcaggactctcagtaggaagaggaaagtgaaacatgtggttctagatttcaaacttccaactaactatcagggtttgtgaagtttctgggatttttattctaattgcaacctgatatattaacctgttattgcttcacgaatgctggcagaagacatgatagtcctgtgtcagaaacaaaggactttatcactcatggcgaagcaagcagcattagcttcactctggtttgcactggtttctctttctctccaagttttatgggccgacacatgtgggtctacatgatgcctgtctatgaagtgggttgggtgacagcaacaggacctggagcctggagaacttattgcatttgcatagagcaacaagcaagcatgatctgtgtctgggggatgggggttggtggcactgttacatcatccttcattgatgctggacaaacacagtcctgagaaaggggccaggattcttggcacaccaagcaaaaacaggcaggaatgctaaggcaccatggtaggttgcctttgtgacaatgactctctgaaaaggatgctgttagcttgctttttaaagaaatcatgttattttttcaattaaacatttaatatctataacaatgttatagcattggttgagggtagtaaatcaggaaagatctatttttagttgagatgtgtaacgtattagtgtatgtgacatgaagttatatggattatatggagacagtttactctgcaggtgttctaatgcttatgcaaaatcctgaatgtggcatcttgggggatttccagtggtcctgtatctgacatgttattctccaatatactgcagttgtaacatttgttcttaatgcacagatagattaatctccctgcttccactcttcatttgctcatgaagtatagctctagtcaccttcatccactccctttccttggacacagcaacacgtgtatgatcaaagatcttttcacaaatacagtatccctcttctgtgatggtttacaataatcaatagcatagatattttctaggtctgtgcataagtggatatgcctgccactgtatatataggacctagaggatacaacctgatagaacataaaagaatctaattcttagcatgataactgtattcttactgctcctacaaatggactaactgagtcattctcttaccattgtggagtttgcctacaacaattcaccacccttcttgaggtaaaacacactgtacctttgcaactatggcttctctgtcactggctcctttcactgctgactgcgtccaccatcctcgcttccagcagtagcaggaggagttgtggactttccaagaggatctgtgatatatttttggccatgccaataggctgagcaagttttgatgaccaaggcttggttccagtgaaagctagggcagccctattagttaatactacaataataatgaaggaccaataaaaatagaatcatgaaaatctacccatagtcaccataagagtgctccggaatgttccagaatggccttccagcaggtgatcccaagaggtctccaggtgagacccttggattttctggtccttacactggcaggtcatgcagcactgggctaaaaatgcagtaaagcaaactgtgcacaggacaagaggtaaggccaagtgaccatttcacacctctcctctcctccttactccttccccttttaatgttcttcacttgcttactgtcacaccccgggtttccagaacactaactcttctcccacttcactttccctcataggtttatccattctctggattccctgtaggattgtttgctcagtggctgtcatctctgccttcaaccctcactgctcacctggttcttctatatctcggtatgtaaccatggtgggtggggaagcagttttgttaattagagaagtagagatactctcctctgggtttcaggaagtaggagaaattgcttccaggtagaggtcagggaaatacttgtgcaggagaaagcatctgcctggaatcttgcagacagtgtgcatttccaactaggaagacatcaagaggggctgtgcaacaacagaaagacccacaggcagttcactgagggcatcctgagcaagggtgagaagctgagtttaaacgaaacagaacacacatatgtgctagtgattgctgaattctcagatgttgcttttctgataattgtacatataatttcccctctttctttttcactttccaagtgtttttttttcttttcaaagctgcaatgttggttgccactctgaaaactcagtgttatctggagaagcatatgcattttatagtccccatcccttgactcttccttaacaatctcatctttgtggtttctccagtaaatttatctgaacagcagcacattattttctatttatcctggatcatttaaaaattttctcaaagggatttcttcaaagtttactagtttctttctcttgctgtttgcccatattcttggaagcatcacagcattaatgattctgtgattgctggaccgtagaaacttggcccttgcatatttgctttcatcattctttgtttattaggaggaaatccaggaaataaatcaagaaattagagcattctctggagttttactgcggctcagcactccttaaaaaatatgtcctgctgttcatttattccaaagtgtacttgatgattctctgggaattcgctgtccatcacatgttagaacattgcaccattcaaaaattcatcgcttagggacataaactcattggggagagtttcttcagctgtttttctcattagtctttaactttccagaaactgcctcagagaaagctttaaatgctcgctatttaaactacaaatatacagcagtgatcttcccattttgtcaaaaacttccaatggctgctgatggaattgggtctgcaataagaagaagagtgaaagagatggatcagaaaacattagactgcagaatttaaagcatatatttgaacatactgtctgaatgaaaagggattaagccataaagttgaaaacatttatgttgtatagcaagcagcccttctttccaagcagagacttggtcatgccattagtttttccatcaaaatttcttgaattaaatatctaagaaacatcaattgagtggctacagtgtgccaagtatctaaaacacaaacaatgtaagcagagtctctggctccaagcatattacaaattgtactgtaatagcgagatttagcaaatgattttgataatgagccaaataaagatatatgcccagatgtttccaccagtggaggacctctccatgcctaggcacaggctacgattaacatgcttatcgcagtggggttgattccaggaagcagcacccagatgggaaaatgtagccaagagcaatcagggtcaatgaaaggatggtgagtggccaagagattggagaaagtgtgagctatcatcaaagtggcacagaacagcccttgcgaagatacaacaggaggaattcaggttctcatagcatctttttctgtgttgggccacctttcattatatgtgctgggggcagttagaaagtaaattgcaaaatggagttgggtaagatgttcagctctgtctagggaagcagtgaaggcaccataggatgaattgaattctgaaggatgagtcatagaccaatgctgttttattttgtttgaaatgaagctgtcatcaaaatatgtattagataatcaaaatatgtcttagagattttccttctaagaatttttatgtgcatgtgtgtgtgtatatgtttgtgtgtgtgtatatataaatatatatttacatatacatgtgtctataaaagggaatatatatataagagaaaaaatatatttctcattttctgaaaaataagtctatattgaaatgtttttcgtttatatagttaaactatatttatatcaaatatacaatgaattaaagaaaatttgtgttttggttaatctaattggttgagaacattgctctgtttctgattgtattattctgttttctacagaaaaaaataattcttttgggttcaaataaagggactttaagaaagagaacagttacagaggtgaggtctttgttaaaaacaagggtactcagagatgagccacagcagctggagaaaactggtatgacttgtaatgcctgcgagatgttgggggaggggataggagatgctttttgagaacagtgatcaggtagagagatggaggaaaagataactgagaaggtgtggtgccaaaccagaataccagaatatacctctgaacaaaatatatttgtattagtgatatggtttggctgtgtccccacccaaatctcatcttgaatggtaactcccataattatctcctgttgtgggagagacccagtgggagataactgaatcacggggcggtttaccccatactattctcatggtagcaaataagtctcatgagagctgatggttttataaggggaaacccctttcgcttggctctcactcttctcttgtctgcttccacgtgagatgtgcctttcactttctgccaagattttgaggcctccccagccacgcagaactgtgaagctattaaacctctttctttgtaaattgcccagtttcaggcatgtctttataagcaatgtgaaaacagactaatacaattgggttatctgtaatttgttagcctgggtacaattctacaagagtaaaaaaagccattccattcagagaagaagcctgtatgaaggcaagaagacaagaaaatgcacggtgacctggagaccacctcagtggacttcaggtgatggagggaaaaagaagctgagtctgcaggggaagattttgggagaatgcaggctttgtgccacggttaatgagacctacaattagcattaatcttcactagcctacatcttagaaaatatcttccaaattgtgtgtgagactctgtcaaagacaattaaattggacttaacttgttaactagttaatgggacaagttctagttacttcagattctgtctcaggaaatagaaatggaattgaaactttgtgaatgacttttatatcaccatctctctggcatgttttgaaaattgtttgaataattcagaaagaattttctgaatcttactatatgctaggctctgtgatacatgatatacatctgatttcacattttaaccttaggcataagatggatacaaatgctaggaactgaactagaacagtgaaaaaatgaatagagtccctaccttcatggagtttataattcagaaagaaccactgagaatttgaagtgtttatgagcacatgacatttttgaaggacacctggcaggtgttatatgtgaagcagattcatggtgcgccagttaccagtcctaggggagggctcccactgcgtggaaaacagcagaaatcattatgaagtcaatcatgaggaacaggagtccaaacgctttcatccactgcattttgagctgcaatttctacaacttgcacaagtctggtgagagagaatttatacaagtgaagcaactttattgctcacagacatgctgcaagagacagtagaagccatggtgagccaatctctcaaagctcaggaaagcctcgtaggatagatggagtctcacctgcatgttccctacattataccatagctgaggaatccaaaaagcattctgcactggggtttataccccaggaaaaactgggatcgctgggctaaagcattgtgggacattctattctaggagatataggaacagagctcaggctattccagccagttcctccttatctcagaatgttgcattctcagcatgtcccacagttattctgacatttacaagggaaaactgaggaagagctgggtcagccaaggctatcttgggatgtcctgcactatgagaaaaagtggagcttcatctataggtgataattcaaggctccccggagggagaattataaaagctgagacttgaatgtggaagattcagccatgaaagaaagtgctgaaggtgggcatgtcagtgcagagagccccatttcaagcagggaaacagcgagagagtggggcccattcgagacacttaagatcattatgtttaaagtagtggctgcaagagagaaagctaggttgccttgtgcaggatctaaccataaatgtggtttgcaacacactgaccctgaaagataaagttatgtgtaatgctaagttagttgacacaaacccagaaacgcattccacccctggtgctatgagagacatccagtagttagaagctgaatgaggacactgtcattactttgtaaaggctattatttctggtgtacctatccaggctgtcaacgtaaaattctatatattcaaagttaatacatatccgtctctcttcacttggatgtgaaactgctggtggagctagcaaagaatttgcaagtttagtcaagtctgactgacactcccaagggcaatgaggcatttgcccctgatttaggtgaccaggctggtactcctatccagggtcccttcatttctcaacagatatttattgggcacttgccatgtgcggggtcttgtactcagaactggattgattaagttatagctctcaaggcagccacagtctattaggaaagcagagaagattatacatcagagataataccacatgataatgcttcacaaaaggaaagtacaatatcctaagggaaaagaggctacctgaggaatctgagttaattcatttgagtcaccttcaaggaataaacaggagatttataaaagcaaactgccatggctgaaatttcaattcacttggcaatttggaatttatgttagactcaaaggtgtttagtgcctcccgccacccccacaaaaaagtgtccaaatatattccaaaaacttactagaatatttgcattgaaaataatgtttatggttggatataaggatgttaaccaaatacacttacagcactgattttttagacaagtgtcagactttaagcaagaagtattaggatatctacagaaatagctgaaagggagttcttaattaagcccatcatttttgactgtattaactgtagggagacaaacagaagggttgtccagtggttctccacttattgaaatctctctggaactttcatcaaagagaagtattaaatgcattcagatgtttgaaatgggatttttttcaacagctcaatggattctgatattttctcagatagattgagccagttgaagactaagctggagaagccttcagccagtgagattctgctccttcccccccatatgaaaaaagggttattacggcttcagaggattgaattctagatattttggtaattgctaagaagcgtagaagtaagctctcctgtcataaaaatattaaaaaccaatgcagtttaaattgtcaaaacaaaacaatccctttatgtataggtaccacagatggatggatgatgcaatgtgaatgataaatgaccgtaagctctttaagcaaatgctaacctctagctgggatgttataggagtcccattcagaaacggactttgcattgagctagccatgaaaccttacacttgatttagtctgtgatactgccacagtttgatctttgccttcaatgactgattccttgtaagaaataaagctgcagaaccaaatgcacactctctctatagccacttgagacagcaacatttgcagcctacttggtataattgcagatttaaaattacattagaatattttctcttttctgttccctttttttctgaacaattcagatcaaaagttgctaggtgggtctgagcaaggttattttctgccgtgggtggcagggtcctggcttaggttatcagagacccagctgtgtggagactgtcagtgggttggggaaggaggtgacagctcagcatgggttattggagctctactggaataaatagaatgtctgaggggcatgagtgataacaagaaattggttccatacaaaggaatccattaaacaggtaatgatatgaggatattgagagacagactctcactgtcagagaagaaagttaagtatcctaaaagggagaaaattagaatgaaccttattgcatttggatataactgtataaactaatttccaaatatctataaataaaaataaatatgtctatatttaaaagtaaatatagacgtaaatgtgcatataaaaacatatatgcatgtacattccctagtgaaattcactgaaaaaggctgctgaacatcaacacacacattttggattttaaagatcatttcacatctctaacaggcaccagggctcttggaagaaatagctgattccagggcaggggcagagaaagtacaagataagcctggaacttctttgttttcacaaaaatgtaaagaaaagcacaaaaaatgataatgattgataaattaggctcctctggccaaatatgagacaatttaagcaccgtattagtgatcgtaatctattataatttgttgaataaaatgatgagccatgagtcgatattaacataattttttcaaatgagtgaataaatgaaaaatttgatgaggaaaaggatattcaaatagtttcaaagttcttcccaataaaaaaataagttataaaggagaaaatagtaacattacagtggagaagactgacagacaccatcttaatcaagcaatcaaaatgaatatcatcaagaaaggggtgaatcaacatcatatgttaccttataggatataatgagaaaaagtagcattgtttttgtgatattccttatgaatctaataataaggaaatgtccaaattgaaagacattttacaaataacttgccttcatctttcaaaaggctcaaaagcatgaaagatatgaaacatctgaggagctgtaactaatggaagcatagtaaagatatgcaataagtgattaagtattggatctcttgcttgctatatattggacaattggtgaaatttgagtgaggtctaaggtgtagatggtagttatgtgtcaatgtaatttcctgatattgatgtctgtactgtgtatacataggaacatgtctttgtaggacatacaggacatacacactaggagttatactccaatggcttataaaaaaagaattgtactgtttttgcaattttttatggaactttgaggttgttttatatgtatatacataaataaatttatatatataaataatatataaaaatcaatttatatatatacaactatagtagagaaagattaagtttaatgagtgcaagacagccaagtgggagaactggtgttatcacttaaactggtctcactgaaggcttgaaggttagagtttttcaagtatagtttggtggccaggggattagaggataggtgctgctgattgtttgggatgaaatcataggggtgtggaaagcagtcttcttacattgagtccactcctggattggggaccacaggactggttgagtcatgagtcacaagttcagatggggtcagtgtgaaaaccatctcaaaagaccaatcttagcttccacaatagtgatgttttcagcaggagcaattgaggaagtcacaaatgttgtgacctcttcccacgtgactcctgagcagtaagagattacagaaactatgcctactttttagcagaatgtaggcctctccaataattctaatcttgtggcctttcattagtctaacaatggcagtttcagccccccaacaaagagggaatccattttagggagagaccattatccttgcttctaaattaaactataatttcctcccatggttagcttggcctatgctcaggaatgagtgaggagagccagcctgtgaggctagaagcaagggggagtcagtcatgttagacttctctcactgtcataatatttgcaaagctggtttcagtctctgccttaggcttcagtatacctaaattctgaggtgtgagctgcagagatgagaaacagccagtgaccaatctaacttcttcctactgaaagaggacagggtttgggtaggggtcacccacagtataagaggaatgaaacaattttgcagttgtctgtatgtatttatgggtgcctggtttgggtctcaaggtctgtataacaaaaacattagtattcatatttacagttttagtacagcacttaagagaacagcagactaaaaaacaaataatgagccctaacaaagagagtgagggtctttgcttcaggagtccctgcagaactgacctgaaaatttgagtgatgccgctgaatgaccttgaaaacaaatcagatttgaggtcaccagtagagactcaaaaacaatagaccgagttggaatccaacaacaggtataatatagttttttacttgagacataatttttctctctccagttccctatttttaccaaagacaaatcacagcagcaccaatttatttgcaaaacaagtttcagttccattatatttgtcctaattatttgcataaaatgaattattttcataaggaatttgagatttaaccttttaaaagcctcttgagcccagccaaggatttatctgtgcctacagatacctgtacaaattgggtgaattcctgtcttcttgaagtctcaaaatagcttagggtttctgggcttgtcagaaagtgacattctttacttgccacagatcaggaaccctgcacaggacaagatatgaggccagtttctccaaggggcttttattggctctataaatcaacctccgttccacaaagcagtctgaaaacatgtcattccagtaaaaatcttggtaaaaataaccagtgtctctaattgtgttctgctataaaagctaatacctatattgccataaattaagaatattcaccaatagtaaagtatactcctgtgagcaaaatttggagcacatttctctctacctgatttctccagaatttggaaactattggttgtaagaatcaaaaccaaagtaatcagcaacattttgagtaaaaactcatgctattaactcctgctctacttgatattgggccagcaatccttacaaacacatcagctctccatgagagtcctcaaagttattgttctctatttcaatgacacaatttttaaagttatcaggagcccatcagagcacccaacagagtctgatagctagttataaaaccaacttttgaaaagaattaaagtaaaacaaaaaatacatttttaaaattaaaaattagatgacacctttgtataaatacttaaacgttctgaaaattttcatgtattcaaagataaggaaatagggaatatcaaactttttgtaacataaaagattggaaatatcattaccatactggacaataaaatcagtgtaactatggcactgtgaaacaaagaattacttactttctgactcatgaatctcagagaaaacttaggcactgctgtgttcctcagagctcggaagaagtgttgcatcacaaaggatgggcacgatactctgatggtcctcacgtgtgctccaaaaaggggcctggtaatgtagtgaggctctaatgagacaaataggctgcttataaggttctggagtgaactcatattatagtaagcaagattttggagaaaggttggatgataatcctatgtgaggtagaataaagagaaccagtcctatgagagcctgtatctatgttgtttctaattttggtgaaaaggagaaaaaccatcttcagattggaaaagacagatcaaacatgagcaggaaggagtaggtgagttacttaggagacacagtgggtatttgtagaggcaaagacacaaatattggctctcaaaactggcccaagtgtttttttctccaggcagaaatagggtccttgtaaaactctctggcattctgagggatcaggaaatcttgcatcagtgtgaacagaggttcacaagatgggtaggaactgtttcaatctttagaaaggaaggagtaggccatgggttactcctcatattgtaagtttgtacttcaagacagcatactatgcagtatgcctgtggatatgctggagaaatggacaaatgtgagctgattaacactaaatggttgaagccttataacacagatgataatgcactgaattactgactttagtttattgatctgggtgatccagtaacaaaactgtaaaggagaaataaggctttgtgcttgagctagtcctcttcaagatgttttcaaaacatgtaagattcctctgctctgcgtgtaagactccacagtgtgtcaaacaaattggccctgtgtgaagactccatggcttgcagcctgctcacccttacagactccattttccacacttgctccctgagtgtccccaagtaatccctcctatgatgaactttgccctttcatacatctgaatattttctctgtatctcctctgtttgaatgctttttttcttctttacctcctgaatgaaatgctataaatgtttgggaagcagtagcaagataggttttaaaattagaaagaccaattttcaaatcttgcctcttttgcctgaaaatagcaggacaactggagctgttacttaaactctcttgaccttagatttcttctccgtacaatggatatggaggatgtctctaattgagacagttgtttttcaggatcaaattaggtaattaatataatacttttatcacaagtgctcatgtagtaaagattaataaatattagctgccatattgtcattgctatcattagacccgaggctggatcagggtatcattaatagtctgggctttggctagatgtaccagctgtgtgactgtggtgactttatttaaactctcaacgattcagttcttttatctggaatgtcaggacagtaagggttgttttgggaattaaatgagataatgcacataaaactggcatgtgtcaagcacttaataaatgttaactattttcattactagttgcattagtcaggctgccataacaaataccatagacagggggcccacacatcagaaatttatttctcacaattctggagactggaaagtccaagttcaaggtgctggcaaggtaggttccattctgtatgtgcttcttcttgcttatatgttgttcccatcctgctgcatgttcacatgacctcttctttgtgaacaccagggagaaggaagaagttctctgctgtctattcttataagggcactaatcccatcagaccaattccttaccatatggcctcattcaacctttacttacataaagagccctctccaaatataggcacattgggggttagggcttcaacatacaaattttggggaggacatcagaattcatcctgtaacagtattactattgttgctattattttttaaggtctaacataaatatcaccttatattttaagccttctcttactttctcagaattctttcctctttgtatttatgtctttatgtatagagatgtatttcatcttaaaaaaggtttaagttactggcttcacatacaactggctcacaagaaacttcagtagaactttactgaaaaaataatagaacaaacacattcatagggaattgatatcatacttattatatgtgactgtagacagctggagtagttacagtgggtggaagttatgtggattctgggttaaatactgaggaaactttcttacaattaatgttgactgaaattgaaatagtttgcctctgtggtagcattaccaatttattcagctaccttgttctaaatagacttgccctagtgacatgtttgtggctgaaaactacctgagttacctggggcaatgcacttcctctttatgggcctcatgtgtaaaatgagaaagttggtatagatctttctctaaattgtttttcatttcttctttattgccatggagatgatttttttttttggttgtcacgttctagagttttattttttttcctaagaagtcaaacatgtaggtgagtattcaccttaatcttgagccccaagttatctgcttcttttactcacaacacatttagttaaaagagcagaaactcacttgagctagcttaagtaaagggaggtttattgtaaggacatagcaggcaacctcatgagcatccaataataaaaaataaaagaattggacctgaaaagtcagattccaaggctatgacttcttccctgcctaatgacagcattacatttaaactccatttctctccccttgcctgttccatcatctctcttttgaattactaaccttctctgtttcttcatgagtgtgcccaaccaatggtgataactgcccactcaactcaatcaataatgacacaacaaaaacaaattaagccagactttagtctctataccccttaattcagttggttgaaatgagaaaactgattttttcagaactagccttggatggtggcccttgggttgggcctcccttgtaccaagtagttgtggttggtggtaagtggaaataggatcacaacttccaggaactacaagtaggaaaataaaactgactgataaaatagccacagagatggtctataaatatgcaaagaatcctataataaactgctgaatttcaaagaccttcagggaatgaaatatgaaacatggtctagggaaaacagcaagattctcaagatgctagcaggataatgtggacccacagagtgaagccatgttggttcccagtaaggctgacttgagaaagtgtgcttctgttgatatggcttttccttttatttgttaagatataacatatatatattatatataacatatataatataacatatatatattatatataacatatataatataacatatatatattatatataacatatataatataacatatatatattatatataacatatataatataacatatatgttatatatatttaatatatataaagcaaaaaaagcaggggttgcaatccggtgtctgataaaacagaatttaaaccaacaaagatcaaaagagacaataatggtaaagggatcaaggcaacaagaagaggtaactatcctaaatatatatgcacccaatacaggagcacccagattcataaagcaagtccttacagacctacaaagagacttagactcccacacaataataatgggagattttaacaccccactgtcaatattggacagatcaatgagacagaaggttaacaaggatatccaggacttaaattcagctctgcaccaagcagacctaatagacatctacagaactctctaccccaaatcaacagaatatatattcttctcagcaccacaccacacctattccaaaattgaccacgtaattggaagtaaagcactcctcagcaaatgtaaaagaacagaaatcacaacagactatctctcagaccacagtgcaatccagttagaactcaagattaagaaactcactcaaaactgcacaactacatggaaactgaacaacctgctcctgaatgactactgggtaaataatgaaatgaaggcagaaataaagatattctttgaaacaaatgagaacaaagacacaacataccagaatctctgggacacatttaaagcagtgtgaagagggaaatttatagcactaaatgcccacaatagaaaccaggaaagatctaaaactgacaccctaacattacaattaaaagaactagagaagcaagagcaaacacattcaaaagctagcagaaggcaagaaataactacaagcagagcagaactgaaggagaaagagacacgagaaacccatcaaaaaatcaatgaatccaggagctgattttttgaaaagatcaacaaaattgatagaccgctagcaagactaataaagaagaaaagagagaagaatcaaatagatgcaataaaaaatgatacaggggatatcatcactgattccacagaaatgcaaactaccatcagagaatactacaaacacctctacgcaaataaactagaaaatctagaagaaatggataaattcctggacgcatacaccctcccaaaactaaaccaggaagaagttgaatctctgaatagaccagtaacagcttctgaaattgtggtaataattaatagcctaccaaccccagaatgtccaggaccagagagtttaacagccgaaatctaccagaggtacaaagaggagctggtaccattccttctgaaactattccaatcaatagaaaaagagcaactcctccctaactcattttatgaggccagcatcatcctgatatcaaagcatgacagagacacaacaaaaagagataattttagaccaatatccctgatgaacatcgatgcaaaaatcctcaataaaatactggcaaaccgaatccagcagcacatcaacaggcttatccaccatggttaagtcagcttcatccctgggatgcaaggctggttcaacatatgcaaatcaataaacataacccatcacataaacagaaccaaagagaaaagccacatgattatctccatagatgcagaaaaggtctttgacaaaattcaacagtcctacatgctaaaaactctcaataaactaggtattaatggaacacacctcaaaataataagagctatttatgacaaacccacagccaatatcatactgaatgggcaaaaactggaagcattctctttgaaaactggcacaagacaaggataccttcactcaccactcctattcaacatagtgttggaagttctggccagggcaatcaggaaagaggaagaaataaagggtattcaattaggaagtgaggaagtcaagttgtccctgattgcagatgacatgattgtatatttagaaaactccagcatcttagcccaaaatctccttaagctgataagcaacatcagcaaagtctcaggatacaaaaatcaatgtgcaaaaattataagcattcctatacaccattaacagacaaacagagagccaaatcacgagtgaactcccattcacaattgctacaaagagtacaaaatacccaggaatccaacttacaagggatgtgaaggaccttttcaaggagaactacaaaccactgctcaacaaaataaaagaggatacaaacaaatggaagaacattccttgctcatggataggaagaaccaatattgggaaaatggccatactgcccaagataatttatggattcaatgcgatccccatcaagctatcaatgactttctttacagaattggaaaaaactacttcaaagttcatatggaaccaaaaaagagcctgcattgccaagacaatcctaagcagaaagaacaaagctgggagcatcacgctacctgacttcaaactatactacaaggctacaataaccaaaacagcacggtactggtaccaaaacagatatatagaccaatggaacagaacagaggcctcagaaataacaccaaacatctacaaccatctaatctttgacaaacctgacaaaaacaagaaatggggaaaggattccctatttaataaatggttctggaaaaactgcctagccatatgtagaaagctgaaactggatcccttccttacaccttatagaaaaattatttcaagatggattaaagacttaagtgttagacctaaaaccataaaaagcctagaagaaaacctgagcaataccattcacgacataggcatgggcaaggacttcatgaataaaacaccaaaaggcaacaaaagccaaaatagacaaatgggatctaattaaactaaagatcttctgcatggcaaaagaaactaccatcagagtgaacaggcaacctacagaatgggagaaaaattttgcaacctacccatttgacaaaaggctaatatctagaatctacagagaatttacaaggaaaaaacaaccccatcaaaaagtgggcaaaggatatgaacagacaattctcaaaagaagacatttatgaagccaacagacacatgaaaaaatgctcatcatcactagtcatcagagaaatgcaaatcaaaaccacaatgagataccatctcacactggttagcatggcgatcattaaaaagtcaggaaacaacaggtgctggagaggatgtggagaaataggaatgcttttaccctgttggtgggagtgtaaagtagttcaaccattatggaagacagtgtggtgattcctcaaggatctagactagaaataccatttgatccagcgatcccattactgggtatatacccaaatgattataaatcatgctactataaagacacatgcacatgcatgtttattgcagtactactcacaatagcaaagacttggaactaacccaaatgtccatcaatgatagacttgattaagaaaatgtggcacatatacaccatgaaatactacgcagccataaaaaaggatgagttcatgtcctttgcagggacatggatgaagctggaaaccatcattctcagcaaactatcacaaagacagaaaaccaaacaccgcatgttctcactcataggtgagaattgaacaatgggaacacttggacacagagaggggaccatcacacactggggcctgtcaggggttgggggactagaggaggaacaacattaggagaaatacctattgtaaatgacgagtggataggtgcagtaaaccaacatggcacatgtatacctacgtaacaaacctgcacgttgtgcacacataccctagaacttaaagtacaataaaaaataaaataagtttccattcaacccaagtaagtgccttagaaataaaatttatggaacatacgatatttctttaactttataataaattcctaaattgttttgcaaagtgcttgcaacattttacattccacaaacaatatatgagaatccctgttcctctgtatcctctggatgtgtcagttatttttattttttagcagtttaaatagatgtgtagtgctatctcattgtggttttaatttgcatttttctaatgactaatgattttgaacatctttttgtgtatttatttgccatctgtatattgtctttgataaattgagtctttcaccaatttatattaggttgaatgttttcttatttttgaattttcatagtttttaatgtatttcacacatgcatatacacactcacttgcttaatcaaatgttattaacagattttcctccctgtgtaaagcttatacatatatatatttaaaaaacaacattttcaactaattttagacttacagaaatacagaaacagtttcctttttttcttcaccctactttgtctatgttaccatctcacgtgctcccttaatagcattgtttgaagagcagaagtccttaattttggtcaagtccaacttatcatttctttttcctttgtaaaacatgtttttggtttcctgtctaagaaggctttacctaactcaaagttgcgaaggttttctctgttttcttctggaatatttagggttttaggacatatgtttatagtacccattttgagtaaattctgtatacagagtgaagtgtggattaaactttatcttagcttatttttttgcaaataaatatccaagtattctagtaatgtttttttttttttaaaaaaaaactatcctgttttcactaaattttgtttgcaattgtgttgaaaatctcttgaccatgggagattatttctgtattgtatcctactgcattaatctatattctttcaccaacaatatattgctttgattactgaatgctataaatcttaaaatcagataacatgacttctccaaatttgttctttctaaagttgtttcaactctactctttttgcattttcacataaatcatggaatcactaagtctatttctacaattccctgctgtgatttggattggaattctgttgaacctatagaatcactttggggacaattaacatgttaacaaatagtttctaaaataagaattttgggctattgatatgtgacctttttcttttctaatatacagttatgtactacataatgatgttttggtcaatgatggactctgtatatgatggtggttccataagtgtacaatattatattttttccatgtttatgtatgtttagaaacacaaatacttaccattgtttataattgcctatggcattcggtacagtggcatactgtacaggttagcagcctaggagcaataggctataccatgcagcttaggtgtgtagtaggctctaccatcaggatttgtgtaagtctactctatgatggtctcacaatgactaaaacacctaacaacacctttctcacaacatgaccctgttgttaaatgatgcatgactgtacatgtatactgctataaatttacctctatttgcatccaaaatttgatatgctataatttttatttcattcaactcagagtattcactaataacttgtttaattttttttaacttaaaccacatagtaattagaagtttgctgtatggtttcaaataattgttttgttttcactgagacctttgtgtttttgaattttaatttgatttttctttacacgacatagttcataggattccaatcttttaaaagttatttagaattgtttgataaccccaaatatgttccatcttggaaaatattcacatacactcgaaaaaaaatggattttatttggctgtgggacagaatatttgataaatatcagagttcttttaaaattaagcttataaaataaatagctattatttcttcaaaatttcttcttccctcaatttttttcattgattccaattatgcatatattggcccaaatgaagttgtcctatagtcactcattagtactcttcttctgcccaaatattctgttttgttttagatattttaacggctgtatcttcaatttactaatgtattcctctgctgtgttgaatctgctgttcctttcatttagttattgttcatctcagatgttgtagttttcatttccagaaactcaatttggattttattttttgtatctttgtttctcatgattatgctcttttctactttcttaaatatataaataagttataaatatataaatatataaaaaagcatattaatgtcttgtaaacttatttaatgtctggacatttttatctagatgctcaattttgtgattttatgttaattgggtctgtatccttttcctctttagttgtaagttatatctatcttacattgtctttctaagtattctcctattattattagacaattattagttctctttcaagttacctttaaacagcttcctatttttgaagcttgattttaaggcttgttagattgaaccagaccagcatttagtgcaggacctattttccccacttttgaatcaaaacccttgggttaattctttccaattccttatgtattatttatttatttgtttgttcattttacttggaacggtgcaaacagtagctcttcctggccttattttagctttgtagattctttcacctgctcctttcatgtgcttgtcttccaagcttcgggtgttttctgcacttgcatgcactaagcagtgctgtgttatacacttgagggagaccttttgcaaactctggagctaacctaccatgcggttctcttctctaggataccttgtcctaaaatctctaactatttttgttctatccaaactctgctcttcatctgctaacatccaggcattcactgggctctgtctttatttttccttttcgctaggacccagaatctctctccaggcagcaagcatgggcaactgcagtactcttaccatttgctttcccactcatagggattttcagtgtctccaaaaatgttgtttcatatatttttccatcatttttagttgtttaaggtgaggggacacatctggtttttgttacttcatcttgtaagaaacaaaagtgcctctgtaaatgtaattctcattgagaaaaataaaaaccaaataataacaaaagggctttccaaaaaacaaggtgtgatggatctcatagtactgatacaatagaatatttcagaagcagagcaaacaagaccatatggagagaatacacaactatttgaattacatgtaaattaagtagtaaaacatatgtcaaaatgtctatcacggggtttgactcagattagaaactttaatattaggaatgggggatggtgatgttctgcaattctgttcattttctaccattaaattccttttttttttttttcctgaatcaacagtggttcaggaattatcaatcaggcagttagagagatgacttacaaatcataatacaacttacagagtgtattgtgacttacagaggctgcgaaataagttattttgaatattgaattgcctgtttttcttagtctaggggaagtattcttgaaattggaattctgtttttaagtagaaagcagacatgtttagttccaatatagtgtttatttctctgaaattaatatcaaaattcagactatttagtgtttaggcctttccaaaatatattttcaaggtctaaaaagagttaagcttcattttgtatgaatattctcagaagaatactcctcaagtaaattcctaccacatcctcatatttacactgcttttaaataatgaagcaatgcaaattgtttttcatgcatatggattagaacattcaattggttttcaattatgtacctgactgcttttaagaaattccaagtttgtattatgatagcaccagctccttctttttctttctaaccttaagcaattttaagaaatcatctggcaatattaatggcatctcatgaactgaggaagaaagagttcatgaagcttcaaaataaaagaagtatagcagtgctcaaacattatagcacaggtttcctgtcttgtctactggattcaattcaattaatggcattatttgcagaggagcataaagaacacttcaaggtgtttacaaactagaagagccggacaacagggaccagaagacacaccctgaggttcattatctacttactcattcctctctttaataattcacaggatttgtactttgctgatacttactaaacaaagagctggagactgtcaggagagcagtatgaggacacgtcagacaagaatgcagcctctaatgagtctactgagctgtctacactgatcataatcaaccagtcatgataagcattcccttttgttagatgcttgctctgtaactggcacttttatatggtttaactagttgactcttctcagtagcactgtccagaaggtgttattcttccaattttatagatgaggtaataggaaaaatagcattcactaaattactcaggaaatagtggagttgccgttcaaaccaagatctatttgagtctaaaattttttttccactatgaggcatgattccattttcctcaagatttctctcataaattaatatcttaggccaggcgccgtggctcacgcctgtaatcccagcactttgggaggccgaggcgggtggatcatgaggtcaggagatcgagaccatcctggctaacacggtgaaaccccgtctctactaaaaaatacaaaaaattagccggacgtgatggcgggcgcctgtaatcccagctactagggagactgaggcaggagaatggcgtgaacccgggaggcggagcttgcaatgagccgagattgtgccactgcactccagcctgggcgacagagcaagactccatctcaaaaaaaaaaaaaaaaaaaaaaattagtatcttagagataaacttggaaaagaaagaataggacaaaaatagaaaagagtaaaattgaccatatgtgctggcctcatcctctctctgtatagggcagaccatgctgggcctcaacctaaggacatgaactgctctgctcaccagcttccctgcactggcttagctgctcacactggcctccttgattactccaggcacattctcatcttaggacccttgcctttattgtcctctttgccttggagctctttccccagagattcttatagccaccacacttaactgccacatgtctgtttaaatgccacattctgaataaactctttcatgaccacactatggaaaattgtaaccatctcagcagcatttttcatcattcttcctggcttaatttttccattgcatgtgttagcttttaatatatacattttgcatataaatgtcttccttattttgtttatcgtgtcttacccagttagaaaataaatttcatgaggccaggtattttgtttagtggtgtaatctcagctcttaaaacagtggatggtgcttaatagatgtcatttatcagggttggtataacaaattaccacacactgggtggcttgacatagcagctttttaaaaaaaatttcatatataagtgagatcatacacaaagatagagcatgaaacagaagttatgggtggtagggtgagaagaaatggggagatgtaggtaaaaggatacaaagtagcagatatgtaagatgaacaagtctagagatctaatgtgtaacacgactaataaaattgtattgtattaggaatttttgtaaaataagtagattttacctgctcatgtcacaaaaatgagatcatatgttaatctgcttcatcattatagtacttatttgtatctacatatatatcccatagtatcatgttgtaaaccttaaatatacacaatataatttattttaaaatagaaataaaaaaaacacacaacaggtttttattctctcccagctctttaggataacgatttgaaatgaaagtgtcagttggcagctccatgctgtttctgaagggttttgaaagaaagcccttccttgtctttccctggcttctgctgattcctggcaatccttggtgttctgtggcttgcagctgaatcctttcagtctttgtctccattgttatacagtgttttccctgtgtgtgtgtgtgtgtgtgtgtgtgtgtgtgtgtgtatgtgtgtgtgtgtgtcttgtgccatgccttcttcctataaggcaccaatcattcaatttaggacccaaactaatccagtatgacctcatcttaactaatcacagctacgataattctatttccaaacaaagtacattttgaggttccaggtagacataaattcttgaggggaggaggcatttattcaaaccacagcacttggtatacaatgcatgcttgttgagtgatagactatataaatgtccttcacctgccctaccctgggttcctcgctcaaacgtattgtagcccaggagactcttagtctatggccaactgattaaagaaatgggcccaattcattcatacttgactgtgtccatgcctttgaatctcaatttagccattcagctggcattagccaataagacattgcaaacatgatgcagagattggaggtatttggtgttaaggcttgtttgctatcttaggaaccctgagcccttcatgtgaacatgacttgtgtagaaagagggatcatatggaggtctcccattattctaactggcccacttgagaccatcaaaaacctgccagctctagacaacctaccagctgaccacagatgcatgagaaagcttagttgagtgcaccagagcctgatactgaatagagaaactgcttagctgaaccgtgcctaaatgaccaagctgcagacttatgaactaaatttttggttgattttttaatgcattgagtttaggggtgttattattcagaaattattacctcataccttgaccttcattggctctctattctacttaattaggaataacacacacacacacacacacacaaaacccacaaccctatatctacctacatatatatacaacctactaattcagaattttaatattgttttaattttattgaagacttccaagtataggcagataattaaagaaatattgccaatctaaattttaattattcttaaatttagataccctgcacacaagttctaagacaagagatttacatagaattaacgttttgagatacatttactttgaataattttggaatgcattcacttccgtgccaaagagattatcatatacaaagagaaaatttacactgctgtcatcagatcacatgtaattctgtgtctttgtgcatttgttcagttatggaaggaagagctctataagttctcttccaataatctcaaacataattactttttataaaaatcacatattatacaatgaatagaaaatatattttgatttctttttcacatacaactttcaatttagtcttgaggttgtagaatttccctaagggaaaaaatcctagcagataaaaattgtgtctgcaaaagtctaatacatttggtaaagttagaaaatgcatcatgttcacaaagtatttgtagctagtgcaattttggtgaaatgaatttttagaggttcagtcctttctctgggcctctttggagacagtcaaaatgtctcattgaaacatggattctgcttaattactgattagtgcattctttttaaatgtaactgtgtttcagctttatcaaattattagagtgaaaaaatgccagaaaaaatttacaaaaaaaatttcttggacaggaaaattgactcatgaaatcaagagaggagtctggactttctgagaagattagaatttttaaaaaatgttcccaactccagaaggcccaccaggcacactatccttggagaggttttagggtgagaaaagcattgtaaagggccagcttaacttgactgttttatggaggctacttttgaatagagggccttcacaatgagcccatagcttataagaagcatttgggggggtagagccaagaagaccatataggaacagctccagtctacagctcccagtgtgagcgatgcagaagatgggtgatttctgcatttccaactgaggtactgggttcatctcactggggattgtcagacagtgggtgcaggacagtgggtgcagtgcaccaagtgtgagctgaagcagggtgaggcattgcctcacccgggaagcacaaggggtcagggaattccatttcctagccaaggaaaggggtgacagatggcacctggaaaattgggtcactcccaccctaataccgtgcttttccaatggtcttagcaaatggcacaccaggagattatatcctgcgcctggctcggagggtcctacgcccatggagcctcactcattgctagcacagcagtctgagatcaaactgcaaggtggcagtgaggatgggggaggggagcctgccattgccgaggcttgagtaggtaaacaaagcagctgggaagctcgaactgggtggagcccaccacagctcaaggaggcctgcctgcctctgtagactccacctcggggggcagggcatagccaaacaaaaggcagcagaaacctctgcagacttaaatgtccctgtctgacagctttgaagagagtagtggttctcccagcacatagcgtgagatctgagaacagacagcctgccttctcaagtgggtccctgaccccgagtagcctaactgggaggcaccccccagtaggggcagactgacacctcacacggccgggtactcctctgagataaaacttccagaagaacgatcaggcagcaacatttgctgttcaccaatatccgctgttctgcagcctccactaccgatacccaggcaaacagggtctggagtggacctccagcaaactccagcagatctgcagctgagggtcctgactgttagaaggaaaactaacaaacaggaaggacatccacaccaaaaccccatctgtacatcaccatcatcaaagaccaaaggtagataaaaccacaaagatggggaaaaacagagcagaaaaaccggaaactctacaaatcagagcgcctctcctcctccagaggaacgcagctcctcaccagcaatggaacaaagctggacggagaatgactttgatgagttgagagaagaagacttcagacgatcaaactactccgagctaaaggaggaagtttgaacccattgcaaagaagttaaaaaccttgaaaaaagattagacgaatggctaactcgaataaccaatgcagagaagtccttaaaggacctgatggagcttaaaaccatggcacgagaactacatgatgaatgcacaagcctcagtagctgattcgatcaactagaagaaagggtatcagtgatggaagatcaaattaatgaaatgaagtgagaagagaagtttagagaaaaaagaataaaaagaaatgaacaaatcctccaagaaatatgggactatgtgaaaagaccaaatctgcgtctgattggtgtacctgaaagtgacggggagaatggaaccaagctggaaaacactctgcaggatattatccaggagaacgtccccaatctagcaaggcaggccaacattcaaattcaggaaatacagagaacaccacaaagatactcctcaagaagagcagctccaagacacataattgtcagattcaccaaagttgaaatgaaggaaaaaatgttaagggcagccagagagaaaggtcaggctacccacaaagggaagcccatcagactaacagctgatctctcggcagaaactctgcaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccagacctgccctaaaagagctcctgaaggaagcactaaacatggaaaggaacaaccagtaccagccacggcaaaaacatgccaaattgtaaagaacatcgaggctaggaagaaactgcatcaactaatgagcaaaataaccagctaacatcataatgacagggtcaaattcacacataacaatattaaccttaaatgtaaataggctaaatgctccaattaaaaggcacagactggcaaattggataaagagtcaagacccatcagtgtgctgtattcaggaaacccatctcacatgcagagacacacataggctcaaaataaagggatggaggaagatctaccaagcaaaaggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagtgacttagactcccatacaataataatgggagattttaacaccccactgtcaacattatacagatcaacgagacaggaggttaacaaggatatccaggaattgaactcagctcttcaccaagcgacctaataggcttctacagaactctccaccacaaatcaacagaatatatattcttttcagcaccacaccacacctattccaaaattgaccacatagttggaagtaaagcactcctcagcaaatgtaaaagaacagaaattataacaaactgtctctcagaccacagtgcaatcaaactagaactcaggattaagaaactcactcaaaaccactcaactacatggaagctgaacaacctgctcctgaatgactactaggtacataacaaaatgaaggcagaaataaagatgttctttggaaccaatgagaacaaagacacaacataccagaatctctgggacacattcaaagcagtgtgtagagggaaatttatagcaataaatgcccacaagagaaagcaggaaagatccaaaactgacaccctaacatcacaattaaaagaactagagaagcaagagcaaacacattcaacagctagcagaaggcaagaaataactaagatcagagcagaactaaaggaaatagagacacaaataacccttcaaaaaatcaatgaatccaggagctgctttttgaaaagatcaacaaaattgatagaccactagcaagactaataaggaagaaaagagagaagaatcaaatagatacaataaaaaatgataaaggggatatcaccaccgatcccacagacatacaaactaccatcagagaatactataaacacctctgtgcaaataaactagaaaatctagaagaaattgataaattcctcaacacatacaccctcccaagactaaacccggaagaagttgaatctctgaatagaccaataacaggctccgaaattgaggcaataattaatagcttaccaacaaaaaaaagtccaggaccagatggattcacagctgaattctaccagaggtacaaagaggagctggtaccattccttctgaaactattccaatcaaaagaaaaagagggaatcctccgtaactcattttataaggccagcatcatcctgataccaaagcctggcagagacacaacaaaaaaagagaattttagactaatatccctgatggacattgatgcaaaaatcctcaataaaatactggcaaacagaatccagcagcacatcaaaaagcttatccaccatgatcaagtgggcttcaaccctaggatgcaaggctggttcaacatacaaaaatcaataaatgtaatccagcatataaacagaaccaatgacaaaaaccacatgattatctccatagatgcagaaaaggcctttgacaaaattcaacagcacttcaggctaaaaactctcaataaattaggtattgatgggacgtatctcaaaataataagagctatctatgacaaacccacagccaatatcatactgaatgggcaaaactggaagcattccctctgaaaactggcacaagacagggatgccctctctcaccactcctattcaaccttgtgttggaagttctggccagggcaatcaggcaggagaaggaaataaagggtattcaattaggaaaagaggaagtcaaattgtccctgtttgcagatgacatgattgtatatctagaaaacctcatcatctcagcccaaagtctcttaagctgataagcaacttcagcaaagtctcaggatacaaaatcaatgtgcaaaaatcacaagcattcttatacaccaataacagacaaacacagagccaaatcatgagtgaactcccattcacaattgcttcaaagagaataaaatacctaggaatccaacttacaagggacatgaaggacctcttcaaggagaactagaaactactgttcagtgaaataaaagaggatacagacaaatggaagaacattccatgctcatgggtaggaagaatcaatattgtgaaaatggccatactgcccaaggtaatttatagattcaatgccatccccatcaaggtacccatgactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaccacagcatggtactgataccaaaacagacatatagaccaatggaacagaacagagccctcagaaataatgccacatatctacaaccatctgatctttgagaaacctgacaaaaaccagaaatggggaaaggattccctatttaataaatggtgctgggaaaactgggtagccataagtagaaagctgaaactggatcccttccttacaccttatacaaaaattcattcaaaatggattaaagacttaaatggtagacctaaaaccataaaaagcctagaagaaaacctagccaatacaattcaggacataggcatgggcaaggacttcatgtgtaaaacaccaaaagcaatggcaacaaaagccaaaattgacaaaagggatctaatgaaactaaagagcttctgcacagcaaaagaaactaccatcagagtgaacaggcaacccacaaaatgggagaaaatttttgcaatctactcatctgacaaaggcctaatatccagaatctacaattaactgaaaaagatttacaagaaataaacaaacaaccccatcaacaagtgggcaaatggtatgaacagacacttctcaaaagaagacatttatgcagccaaaagacacatgaaaaaatgctcatcatcactggccatcagagaaatgcaaatcaaaaccacaatgagataccatctcacaccggttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggattataaatcatgctgctataaagacacatgcaaacgtatgtttattgcggcactattcaaaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactattgcaaggacaaaaaaaccaaacactgcatgttctcactcataggtgggaattgaacaatgagaacacatggacacaggaaggggaacatcacacactggggcctgttgtgggatgggggggaggggagagggatagcattaggagatatacctaatgttaaatgatgagttaatgggtgcagcacaccaacatggcacatgtagacatatgtaacaaacctgcatgttgtgcacatgtaccctaaaacttcaagtattaaaaaaaaaaagaagcatttgaagcagaccttgaatacattttattgtaattaacaggttgtcagctttcacacatgtagaagtttttctaagggagatttttacatagttttatcagaaaatgataatttatgcctaacatccacccaaagttatttttctatcaatcttgttcacctttttatgtggaagcagcaggaaagaacatgttgggattcttttttatgccgtgttttgatcagcttagctctgtctgaatgtttgttgtaagggcttgtggctgcttctagcaggcaccattgttacgcaggaatatagacactttccgatttaaagaacgctgtctctttacgaagataattttttccctaaagttttggctgagagaggagttgaggccaaacctgagaaaatgcttacattgtactgttttcctgaattcagaactatctttaggtggtgtgggggcctcttcacagccccgtgctgctccatgcttttgtgctccatcacagttgggttcttatcaggagatgaggaaatggaggctgtgaacagaaagttcattggtctaacatgattcgactttgggcaagtattcaaccagtgcttacaaaggcaggattgggcatgcagtgagcatcctaaacctttgagaaattcagccccttactcctgtatataatctttatataaaaatatttattaaagccagtgtgcaaaagttgaaataaggatgtctgctttggaaagagatttatttctctggagcaataatgataacaaaatattgtaaaacagtattttatcataattacaatcatccagtgaacacttgctatgagccagctctctgaggttctgctcacatcacatgttattttttcacttctgctttacaacagcccttttgggtagatacaaatgtgccctttttactgttgagaaatccgaggctcagagaggaagagttctgagcagagttagggagttgcacagcctaactttaaacatgccaatgtgtctcttaacctcattctataaccactatgctattgcatattacattttaaatgtgcatttcagtgtcctttttatgtttaatggctatatttaaattttgtgattttttttctcttaatgatttaatgcaataatagacagaagccagaaaatggtgacaggaaaactgggcttcagagatgttagtaaattgctgaaggcaatgcaggtaactggaaagatagaattggacctgagctctctctgaccacaaacctcgtctaatatattatgatgtttttgaggcagcctggaccagaactaaattatgccactactattttaggaataccagtccttatatgaagatatctaagtgatactgcctggttttgttctgcttttcccttaagataattcaataagggaagcttcatgtggtgtgtggaataaaggggaataggcaaagtgttggatgcaataaagttttgacatttttgaagagtaacttattacttgggaccttaactaagtttatttcagttctcagatcccaggtccatgtccatcaaccttcaccccacaatccctttagaacaagagcaatgagtaagacttcagcagccagatgatctttaaggaagcctaacattccatgataatacatttcatttgaggaagttgaacttattatatgtaacatgaatcaaagaaaacttttatttttgaccattatgttactgataaaataggaaaaagggcaaaaaatttctcatattaaaaaaccataactttacaataaaagaaatctattgcattcatatgtagtaaatagttataagtctatttgttgttttgcttatttcttgtttatgtttctttcctactaattcaaaaacacctaaagaatcatgcattaatacagtatttgtacgttagggaaaaagtccagaacagcaactaaaaagatgaaaaataacagatcacattttattgaaaaaagcataatgcctgatttcatagtctaaaaacatgatagaatttgatgaatgtcaacatacaccatcagaaatgattttgtcttgcattgcagaatgacttcttttacgctttgtatcatcttgggaatcacaacagcaaatatgtatttagaagcaaacatcaccatcatttactacctctgtaccctcatacattccaggtgtcatgtagcaccacaaagacacacgttctgacttcgaatttctaaaggttacccattaaatttaatgggaaggtgttgtacaatgagcatattttgttgaggtctacaaaatatcactacacatgtgttgtaacagtgacattttaatcacttatttagttgtccaccatgaatatattcagctcataaaaaagaatatagatttgtctctaaaaatttcccaggagcaaaaacactattcaaagtacctaattttgagcctttgtttttaatttacacccagggatggtgtgataaaactgctttcatttaacacatttctagtctgtttttgaaactatctagatatattgtggtctattgagcatctgtcttaatcagattaaaaatgttctctaggtcaaaaattttcttcaaaaatgtcatccattcaacaaaaaaatacactggactcctactacattccagtcagagtagtgattagacagttgggatgcctgctttaagggtgcgtgaattccaagaacgaggatagacacccagcaacaaactttatgaaagggaagcccagtttacctgaaatatgtgaatatgggacctaactttatgtagtaatatattcattcctacagtgtcctgtgtctacttagccacagcacaaacatccttgcattttaattgtgtgtttatacttttgatatgagggacaaaaaattagatgttttattcatctagtttccagcagtgtctaacacatggtaggtggtcaatatattttcttgaacagaagttaataacggacatggatacttgcagagtatacagtggacttcactatcaatcatctcataagcaggtgggcaaggctaggtaaacaatttagcctagattctcttctactttattcagggtatattttaatctcaatcgcagtgttttctttaattgtgcagagaaatccatggcctaacattagagcatgtcacaatatctaaagatttagaaattcttacgctagataaataaaactaaagaaattggttgtggggggtctgcttcaaatgaacaataacttagaccttgccatatttgaacaattagaaataaagaaaattgtttacacagttggtctagaattctttgtatttttttttttttgtagcaaatcctaagtagaagagtcatcaaatttacctagttctggatatataaacttacttaaggaaatcaggactctttctaccatatgctgatgagaaatgctacttagagaggagtagaggcaccacaagacgctatgctatggcgcacctgctcctgtcaagtaccacatgggaagtcttagctcagggtttatgagaagcagaccctgagtcaagcggtattgaggcaagcatttgtatggaaggaattcatttggtcagtgatcctaggaagcagtgtgagggaatggggaagggagatcagggagggagggatatcaacaaggagtgcagtaagtggcaggagatctctgtggacatctagagctcaatccccttggggtctccctaagagattgtgtggagctgtctcacagagagaaaggggactggggcttttgcacccatgcttatcccttcttggttgaggttgatcctggggtgttacctgcagcctgtccccgtgtgtgcctggcactctcccaggggcagagaggaccctcaggtagaaagatgctggatgcaagccaggcgcggtggctcacccctgtaatcctggcactttgggaggccggaacgggtggatcacatgaggtcaggagttcgagaccagcctgaccaacatggagaaaccccgtctctactaaaatacaaaaaattagccaggcatggtggcacatgcctgtaatcccagctactcgggaggctgaggcaggagaatcacttgaacctaggaggcagaggttgtggtgagccgaaattgcaccactgcactccagtctgggcaagaagagtgaaattccatcaaaaaaagaaggaagggaaaggaagggaagaggggagggaggaaggaaggaaggaaggaaaaaggaagaaaggaagagagagagaaggaaggaagaaagaaaagaaggaaagaaagagagagaaagaaggaaagaaagaaaaaagaaagaaagaaaaaaaagaaagagaaaagatggaaaggatagatgctggatgccgttggcagggctggaaattgttcaaggtcacctcctgagtaggttgaaaagacatggacagggaccaatagcatcagcttcatgtatcttatgtcaactcttttaatgagctggtgaggttggctacattgctccattgttataactgagaaaaagccagagaggttagtaacttaccctgctttatcagtataataaatgatagagcaaaaactcaaacccacctatacagaaatccaggactttttgccttcccattatactatgcctaatatataggaattaaacaaaggaaatgttataatcttttatcaaagcaaactgcatcaaaaaaagccgaactcaaaacctgaaacattagatacctcaaacatgttatactctgctatcatagcacaatgacagcacctaaatccaatggctgctgtctctataagacaattatttataatttactgcttaatatttttgagaagaagaatttgatttagatattaacagatctttttgaaagaaaaacaaatgagggaacattaatttcaagaatctgggtttgtacaaaaaaagcttaaaaatgcctatgtttgttcatcatacgcactgaaatgatttttattatttattattcatttttaaagaaattcggcactctctaaatggcttactatatgatccttcccaaagtatttgaaattttatggtataagttaagggacctttactttctttctgaatccctgttatacctccttgttactatggcaatccatcccaacaactgtctttcttaagctatgtaatttttcctcattaaattattgcacaccctgcaaaaaatcaacacggaaacattaacaatgaccaagacacagccattgatcaatattgatgcccagaacccaggcagacatgatggagtgagaggttgtaccttaataaatggccactttgccttttctgagcagttgtcataaaaacacaccttagaggggtaatttctctttccaccagaactttttattgcttgtaatttagagccacagtaattgagatgttgagtggggaattggtgacagaaaggtgagagcttggggaaaggaagttttgacccacatgttaataacgcatgatcacagcttgagaaaatggtagatcctgtttttaatagcagaaaaaaagaggcttgtctttgttggagagtaaaatagcagccctggaaactggaggggaaggaatggattaaaatgaagacactgggactgtatttgttaagaaagttgtattggaacttggtaacaataaaatctatgcacttgttttaacctgatacagggtctttgaattttatttgacatttcttctcttttctccagctgctaaaaagccagacctgtatttgtcttccaaagttaacaaatgcgtaagacattatggtatgcatttcatgattaatctctcccttggatgaaaattaatttcctacttttcttccttcatcctttaaattttgtttggtattgtgcatacttctggtctcaaagccttcacagaccacacaggatataaatcaatctgtcaattacattttaatgaacatgacaggctaataaagtgaactagaccatcaaccatatcataaatatattgcattatttttgactctttttatttacaagaagaggaggtcagaaacgcatttttccttttaatgttcacctttgtttagttacccttttcttatatttacgtataaaaaagtgaggtttcattcagcttagaaaatatctggctttaggcaaacaactagtgttccccatcccataaactgtcaagaaagggtgtgagaaaatatattttacttcatgattactgatttgaaattgtgaagacatagttccaggtttcaccccagatgaagctctcagcaaatgtaattctgacccatttcagacagtcataagaggatgtgtgtcatgtacctgttctgtagacatggtgagcgctggctgcttgcagggcccatgcaacactgagctccgacccctctcaaagctgggccacagttttgatggtgtttctctcagcacttcagagtcctcctgactccgcgggattttactctatgttttattcatccatatggtcacaagacttgaggacagtagagcctcaagaaacagctgataaaggagtgtggggtttgcccccccaaaaacagctcctcttttattcctgtgactgattccacattctttcattttcccaggccagacatcttttgctttcattgaccctctatctcatttggaagaggaaaaatcatgaagacctctggattcttccttagaaatatattccacagcaaatctctccagactttatttcatttaacattatctttatctgtggcctcatcatactgggtgccatatactgacataactttgggactgtcttagctatctccaactgtccctttctttatgctatttgaatatacctaaaatacgtttttttgttatgtcttttcccttatgaataatttctgccatttaacatttagtatgtccttttcgggcattcagctgtctctacaatctggcttcacctctcacccacattcttttcaccagactccctatccattgttggccttcagaaaatctgttattatagtgcagattctgattttacacctcttgtttctcctttgcagaggcatgtaagaatcagtctttaatgtcaacatctgcaccaccaagagcctaaagttcttcattgctcacatccatttaggtttttcatcatgacacctgagactctaaaataaatagtgaaggaaagatggaaggatactggcaagacattttattttacacatgcaataaaataaggatgtgccagattaaaacataaagattaggatggacacaccaagctcaaaactgacattttcaccctattacaccatgacttaaataaatattagaattttcctgggttctatctcatactgcatttcttctctcgctggaccacaccacacatttcttagtttcacatatcactaatatgccagtgacacccagggctgtgcctcttgtgtctatctctctgccgtttgttgtcctaactctacctagatgccttcaaacaagctcaaatgttttaattcattgtaattttcaccaaacgggtttatcctccagaaatttctgttgaatgttcaccttgaagtctaccttctgtagaagacttacaaaaaagaggaagaatcagtggagagtagagactccgagcagaagtatgagaacaggaataccccaggcaagggggagggcccattgtggtgcttgggaaggacgagatggtagctttaagtggtaaataagcatgctacaaggcacaagagtaatgcacaatagaattgaagtccaatggataagtttgaaaatattctaaaacaaggtggaaacaaatattcatatttagactacctccccctcaaaagagtggaggaaaggcaagaatagaggcgagggataggaaaagaaggacagaagcaaaatgtattgttgaaaatttaaaaggtgatgtataccaatgatcaacaaataatggcctagaatcacctattgaaataaaatgagcaaaacaactgtcctccagaaattcccagttataatttatgtgaaagtaacagacctaccactgaaggacggttgaaagtaaggggttaaacttagaaaatactaaccacaagaaagttatgaaatataacaattttagacaaaacaaactttaataataaaagcatttttagacatttgaaggataaaatgtgtgataaaaggttcaatttagcaggaaaatgtaacagttatcatcttaaatgcatggaataaattaatatcaaataagataaaggaaaataattgtatcattacaaggaaaaatataaactacactatcaaatatgggggttgtaatacaactctcttggcagtcaagcatttaagcaacatacatacaactaaataagccatctgtatagcataaactacatgctttttattttttttacacctacaagagaactcacgttctcaagaacatacacaattttcagttcgccatggtctttgcattacattttttcagaaatagaatttgagataaatatgttagtaccagtactttacttatgaggggaaggaaacactgataaagaaatggaaagtgagataggaaaaggaaaactaaagcactgagttttaaagcagttatcagcaagagtaaatggagcttgttcttgctgagaaatggacagcataaaacatgcatctgagttcttccacacagggacgatggagctggaaaattgatagactaactcccatcagtcattggttgagtgctgttccttgggggctgcaaattctggaacacctcttgttccagctcagccattgcacaggtcattgcagaggccatggccatcgaaagaagtttacaggcaagcaggtgctggcagttggaaatcaagaaaactgaagtggagaggaagacgcaataaggctaaactatcagcaacgtttgctacaaccccattctagtcaatataacaaatataggcacatttaaggaatctgttccatattgtttaaagtctcgggtacagagcaactaaaaagtataatagtaaagatattttaaatccacatacatttgaattttttaaaaaaagttctaaataaatacacatcaaaaataaactcccaataaaaatttaaagaaatacccagaattgagagataataaaattatgtatagaaacttaggagatgcagttatagaaagatttaaaagaacatttacaaaaaatagctgaaagttaataagctaagcaactacattataaagtagaaggagtacagcaaaataaccaaaaaaaatcgaaggaagaaaataataaccaagatgacagtagaaattaacaaaagagaaaataccacaaaaagggtcaagagagccaaatgttgatagaaaaacaaaaactagtggaacagataaatacctgggaagattgaagaaaaataaaataaaataaattataaataactatattagaacattaattatacatataatatatagagagcctatataattatatatataatgatgtgtatatataatgtttatgtctctaacatagttccatatatgtggaaattattcaatacattttaaaatttatattaaatatttgaatttcttttagtttaacatttgaagtgcccctcaagttataaactagtttttggccacaggtttgtacacataacaaaataaaacattgcctttgagattaaacattcctctggagacactgatggcattttacatgacgctacaaaatcaaatggaacactgacattggtattacacttttagctggattacagacgttggtcagttctatctttacatgcaaacttgtatgtattatgctgtgtccagttctatagaaagaaatcatttttagaaaatttaaaattaagtaaaattatgctctatatataaattttaaagatgcttatgcatatcataagtatgtatcatagaatacgtatttaaaaacagatgacaacataggtgaggagatatgcagtgataacgaaaggtcattttaatgtttcagtttttagatgggtggtgagttcacgcatttcattttcaatttatctttctaatttacgtacatgaaatataaatatatcaattgttgtggaataaaatatttcattgcttgtagaaatttggaggctgttgttgatctccctaggactgttgcagaaggcatttccaaatgctgacacagagatgatagagtaagcattgctctattgagtggatgggaggggaagagagaaaatgtaggcctgagtgggcatagcaagcaaagtggcttttgtacgagtttatgcttcagcctgggagctgtgcacagtggatgacacttgaatgactaaagatggaagagacattcaatgcagccacagggaagggagggagtccatgggcgtctgattgatcactatcaaagaagattaaggaagtttgacctccaaatcttggttggacatttttgtgcttgggggagagttaagagaaaagatctgaaacattttctcttagatgcatttatgtttttactggtgccctccaaaggtcaagggttgagagaacaagagaggctaggccggatgtggagagcagacacgagtgcaaaatagctacagggaagaaggagaataaaagtcatctgagagcgaataaagattgactgaaagcccagctgggatcagattacacaagtgtgccggggaggtttattatattctttgaggggagcctgacaagaattgggtattaattagtcactgatctgtattaaatgatatatatatttttccaggctgtggtgatttggagtgcatgtagattggtaggaacaagcatcctaccaggtcagttgacggaggactttaccttccatgggcatcatatgatatggattatgaggacacactcaacacaccctcaatttcagggatattgaaatgcaaatattttgattgagataagaagattcttggaggagcccacttatatactaccctgactgctctccatgctgtgaagagggttttttaaaaagaacatcatgatctggagaaaggcaaggattaggtttgctgagctctacattgagaagatgaaggagagtgagagattgggtgctcccagacaatagttagtaaaggaattaaaaacagaagccaagaaactacgaagaaagaaactttgaaatattcctttgattgaatgcccattaaaaaatatgctctatgcaaatttacatctatatctgtttctaaatctatgtatgtatgtgtgtatgtatgtatgtatgtatgtatgtatgtatgtatctatctatctatctatctatctatctatctatatctatcttatatgttttaaatgaatgctggcgagcaagtttgatgtagaggctatccctgattttaaaaggtgcttacagcccacagtgggtgggggtgggggtggtgacagataggtaaaggaacaatttaatgctatcaaaaaggagggacgtattgctgggtatgggttgtggataaatgtggcaaacctcaagttcataaaacataataaaatcaacaataatcacaacgggtactatttctgagcacctaacttaaattaggtgctttacagtatcatttcaaccacaatgttcttatctcattttgttgaaagctgcaaactctttaagggcaggaactaggtatgttctgtttatcagtctacactggagacctactgtagtgcccagctcactgtaaaaataaataaataaatagatagataataataataaataagggaactgaatctgtccaccacatcatgctgcactgctggtggggagaactatgttaaatcctagtcagccctcaccagccatcccagcctggagcaactgagtctagtaggctgtattaagtcctgtcccacaggttctgtccatggcttctcctctttggctggatacttgagagtacctaatattcagcacctgtccaagcaggcagacattcagaagccagctttcccatcagcagtagcatttgtgctccaacctgggagccgtgcacggtggatggcatttgaatgaccaaggatggaagagacacctgcaaacccatttgtggtgcatatgtccttctttgaaagcaaacatggtaatttgtgcattttaaagtatataatatatttggaggcttcaaaggaaagggggcaacttggaacaccaagtaaatgacaaatgtatagaatcattttaaaggaaatgcatgaataaccgatttttgaaaaatcagtaaatagctctttccccttctaattttaaaagttgggttattcattttccccaagactttcattagccttagcaaatgcgtgctgttcaagcctcaattcttgccataagtgctattcagagaacatctgcgtgtagcagctctttctctgtttccaagcagagctgcgacacttgctgaaagggagctgccacactgttgtgtcatcgataggcccaatcaggctgcctctttcagatgttgaaatagcatgttttctgtacaaagcagatgcttccatcatatgggactaaattatcctaagaggttgagggaagggtcttaggatgagccaaaacaggaagctctgcagtaggcttcaaatgctgctaaattctggcgtttgtttatgttgaaaaggaaacaatgagagaatgggacagatgatcagtggcataaaatcccaaccaaagctgagaaaaagaaaatgagctcatagttaggttttctgtaaaatggccctgtgtggtttagttagcagagactctgggctgaagctgtggtccatgctctaaggggtccccaaaaatggatcttggcaggtagatactccctgagtttttaacttaagtcaaaatgacttcgctacgaaaagggtctacttcagtgaagaaaattggggtctggaaatgaagcttggcataagccagttgtggttagggaatctgctctggccgcagggttggactctggtaatggtacttcctgtccagattagggtgtcagaatgggcatcgtggactcagtgggctgatggatcctgtcctgtgggggagtcttccagcagctgggtttttgactctgagattcttctaatcttggaaatgctatcattcttgaccctctatcagccttaaagaaagacctcagcaggcaattgtggctacagaaggcatactcagcttccatggagacaggacaagtggccagggaaccagcaatgtgtactgacgtgcagaggctcaacaatgtggtaaacaagatctagcaaaacgaaaaggccagaagcacatttgtagagcactataatgaagtcctaggctacctcattcaattcctaaaatcttctgaaaggtaactattactgtgctagattatatagaaaatatagaagcttatagtggtgaagtaacttgcccaaagtcatgtgcctagtaaatggttaaggcagaagggagtttcaggtgtggattatatagcttccatctttaagctacatcaaacaaccaaggtgggggtagggttatcaggtaagccttcagtattgtagggccctcaaaacagacaatctgtatatcatggacacagcagcacatcttggaatccaaaaaccttgtgagcctggttcagatagactgcgaaacctgaagttcagcctgtgagatccaacagtgatggaagcggaaaggagtcactggcttggtttggatgcacatgagcccatatacagaaaggcatttttacccacctgtaataccaggtgaagtccctgattagcctggtcctatgccctaggcagagtcgagagctcagtgctgcactttctccagcgggatccagaatgggccctgcctgatgacccggaattttatccagcccctttcactacagcactcagaattcagccaggttagctaatgttcactcacactcctctcagattgtccttcagttataaaaatcagcatttgtcagatgaatttattaatgtcttccccaagttcagaagctaatttctaaatgaattccatgacttttgccctgcagaacagggagtgcttacatgccagctctctcagaaggtgatcaggaagtttggggtgagaagacaatccaggtaggatgattcctgcaaaatagagctgccgtgttcctgcatgttgtgcctccagcctgtttaatgcacagctatgtgtgaagaaggaagttaataactctcattttggtatgttgggacatcatcaacatgcctgtagggttctaggtatataagagaactccaacatttaattaaactgcctgcaaacattgattcatctgttaccacctgaatggattggtcagtgaatgtctggtgctccttcggagaactctggaaaatggataactcaggggcagaaatctggtgttaaagggccacagggagaatgggaattaattcttccagaaatgccttagggaggagccaacctacaaatctttcataagtatgcaaacttgggccaggatagtgatataagatctagtaggaggcaaggggagtgtgagaactgttggatactaaatgtgcctttgattcttagaaacagctgttttatgcagagattacttgaatttctctcctaaatgtttgaaagaaaaactactggttaattaggattatgctgactttgagttaattttctgaataagtgttcatccaaaaaatttgttgagaacatgtagtagatgttcaaaaatggaaacaaaaccactggctagggaaatagctataggagatcttgctctttagttttcatgcttttataattaggatattgactacagtaatcatcaatgttccaaacagactcaacttaagtatccatcattatatgaattagtttattaaactcggacattgaaaaagaaagatcaaaatttagttgagaatgcctgaatgcatcctctgaaatgagggtggtatttttcagtagcataactttgtgaatacttatttatgacaaactcagtgtcatgcacttaattttctcatcagcttttgtttttgcacactcatttttggtatgactctttaaccagtgcaatcaggggagtagaccccatcttggtttatcctgaacgagtggttctcaacttgaggaactttgactctctactgaaaggaccatttggcaatgtctgcagacatttttgattgtcacaactgtggagagaggatgctagtggactctagtgagtggagcagagacgctgctaaacatcctctaatgcacaggacaatcccccacaacaaagaattatacaatccaaaatgttcattgtgccaacattgagaaaccctatcctgaccgaggtctccacctttagcaaataaaaagacaggacacttagttaaatttgaatttgagataaacaacaaataatatgtatgtattatgtaacatataaataatacattagtatatatatgttcaattgactataaaaatgtggtgcttaatatgtcccaagtttttatgaggtatattttttctaaaaaaaaaatagttcatttgaaattcaaatttatttaggcatcctgcattttacctggcaaccctagatctatctcttgtacaagaatgtgacctattccatgaattctaagcttttctgcaacagaaggaaattttattttgtatgcagcttattgtgccattgcataggctttgtaataaagcatgtctcaatgcagattccatttctgacctactgtacaatcatggagaggttatttaatttctttaagccttagttacttcatatatgttatgggaataattatgacaacctcataggtttattgcaaaaaggaaataaaataatgtatgtaaaatgactagtattcataaaggataattatgatttttattattgatttattattttcctcagtaataccttgaagttctctgtcagcccaggttttatcaagattttttttctttgtaatatattcagtggatttatagcagcttgctttactagataacccaagaatgggttgagttttatcttttcttgtaatgtttgttgaagtaaaacacaatgatcaagggagcgaatcttgattatactcttcatcatttttctttacatagtgaacatactcatgggtatcatccagctcaaaacgcagaacgttgtcagcccccagagactctaccatgaccttttctattcattacacctctaaaaataatgaatatctttatgtccatcactatacattaggattttttttaatttatgatgaatggaattatgtgttaagtacccttttgtgtctggattttcttttcttttttaaaaaatatgttttcttcacattatgtctgtgaaatttgtcatgctgcatatagcagtagtttaatctttttgtttactgtatgacattccgtcatgtaaatatgcaaggctttattcacctattcaactgctgatgagcgtttgggcagtttccatagttttactattggaaatggtgcttttattaatattttgtatgagttttgatgcacatacaaatgcatttacattgggcagaacagttgtgatacaaggcatgcacaattttagggttaagtagatagctatacaattttgcatacagaatgcgctaatttatgttcctactaagagtatcagaaaatttcattgtcccacattgtctctacagttgagattgccactttttataaatgttaattcttatggtgggtaggtaatattatcacattgtggtttgaataacatttttctgacaataatgttgagcaccatttcaaatgcttattggccatagtaatatagcgttttttattattattatgccagcaaagcaggttcgccatgcaatggttatcatttcattccaaagcatcatgggctgcaatttctactccttgcacaagttcaggatacttacaaacacaggttacatgcagtagatttattacctatagacaactagaaagagacaacagaggcctaagattcatgacagcctgatcccagaggctcaggaaagctgccaggacatagtctcgtttgcgcatgccgcacttgcactgtagctcaggaaccttggaaacagttctcctgtttgtcaaacatcgccagacatccaattctaggagagattggaacagaacttgggctgctctggagagcccctctttatctcagaatgttgcattgttagcacattctatagttattcttgagaactatagacaagaaatgagagagaactgggatagtctaaggccacatggagatctgtcttgcactatgttgacttagtttagaggccccggctggagaggagtcaggcccttttcttgtggggtcaattaagtccgatcctcaattacctccttgtttgtctctcagacccttggccgctattcagtcgccatatgtgcctcggagccaggtaccagacaaccaggaacaagcccactgaaattatttcaagtcatcaagcctaagcctgtttgccctgcctaaccctttcattcctgcagaaaccacaaaaaaaggttttcgcctactgctgccctttatccctctggctcaactctgacgctggtgctcccacgagtggccccctgtggcatggcacgctgtgttctccccagggaactgtgagtataacaaaactgtaaaactctttcaagcttctcttttgatcttcctctggcttcaccatacctcatccacattaatatggttaaatcagccatctgatgtcttgtcaaatgacaatgttttcctcccatatttttttggcaggcctttgttttccttgttgaattgtagaaattttgttttataaaggatataaatcctttgtaagatgcatgcatttccaattttttttttctacttcgtggcttgcgtattcactgtcttacagtatcttctgatgaagagtaattaatgatttagcaaattccagtgtatcaatattttgctttatgattggtgctttttgtgtgcaatttaagaaaaccttgccaactacaagacaatgtagacattttcctatgataccatccagaacctgtattgttttaattttcacgtttacttagtggtacatcagagttgtttttctgtgtgtgtgtgtgtgtgtgtgtgtgtgtgtgtgtgtgtgacgtgaaaagtatggcatacgtgaatggtgaagtagatgtgaaagattcattttgttcttcaggaatatctggctgacccagcactgttcctggagtatgcctcctggcattacaatgtcaccttttcataaatcagatgatcacataaattcatttgttgaacttaaatttttgatttttattctttcttttcttaaaataatatatccactgaagtctatcagctttttaaaagcagggctttagaaccattctataatttttgacatgccaaattctaaattttcattgaaattaaaacaaattcttttattttgatttcttttttgaaccatggaatatttaatactttattgcttaatttccaaagatttgaatttctttaagttattattttgtgaatcattctcatcttaatcgttttaaacatttctagtgttatttggtttgacaatattttaagttaatttccatatgatcagattaacatatcttattttttaagacttctgttatagcttagaatttaatcaattttagtacacattcacatggaaaaaaattgtcttctcttgatctgcgttcaagttttatatgtgtgtgggctgagtgcggtggctcacatttgtaatcccaacaatttctcccaaattgaggcagcaggattgcttgagcctaggagtttgagaccagcctggggaacacggcaagactgcatctctacaaaaataccaaaattaatcagccatggtggcactcacctgggtccccaccagctactgggaaggctgaggcaagaggattgcttgagcccaggaggtcaaggctgcagtgagccatgttcacaccactgtatcctaacctgggtgacagagtgagactctctctaaaaaaaaataataataataaaataaaaggtttcgtgtgtgctaattatattaatttattaattatattgttctaatattttatattctttctgatttacttactgtcacttactgtcatttaccgagaatgttacttaaacatgaaattagaaatttgtctactcttttaaagtttttttcatcattttttttccaagtttaccttagttttagtagtaagtaggaaaagttttaagtctcagaaattatgtaattggagacaaatgtattttcggggacctttttttctatttctctacaaaagttaataatagtatccattcctgtcttcctatggtacataacgttcataacattgttaattataaacaagtctgtggagccctgataaactaccaacaggttttctaggactgcccttgacataatttttgacacttaacaaatatgactaagttagtaggtatataatttttgtctccccttaaatagaaccaaaaaaggaagaaacatttgaatgtttaagcagataaatacaattactacaatctttattatatcaacctgttagaacatatttcaattataaatgcaacagaggggtttcaaagtcaaaatgttcaattaaggcacctggtttctattagattaacatttgtgtaatctatttttgtcttttattttactttcaagctacttatgttattgaatttaaggtgaatttcttataaatagcatatcattgaattctgtttgtttacacactctgaaaatcttgttacccattgtaatgcctctgtgacctagctgaatttctacctgatcttaactctgcttagctttaggagacaggatgtctgaggtcagaagttccccctggtgaccaaaccagttaagactgatgagattcaagatccagctcacttcgcctttgaagaacctccaacttcattataatttattttccatactaaatgacactcccaccagtgccatgacagtttataatcaccatgacaatgaccagaagaaattatgaaaggacaaaaaggaagaccacaactccggttctgaggaattctccacccattcccagaaaagacaagaatactcctccccttgtttttaatgcccaaacccttcattaaagatgtcccatatctgtgacttcctgtctctcattaattgagaagttaatctgtgagtcaagctcccacttcttaagtccatggccattgaataaagcctgcactgcttgatgctcacttttggtttcatgcattgtcttctcatcactgcatagaaaaagaacccattttaaaatcagtaacactttgatttctaacggattaaatttgccattttattgttttctgtttgtttgatttgcattttgttcttctgtttcaagtgggttacttgaacagttttaagaattctgtctttatttacagtgtttcagagttcaactctttgtacagtttaatgttgttgtaggtttcacagtatacctaacatgtgacttgtcatagtctattggtatcaatggtgagtcctgtgaaagtttatttccacttaggtctctttaccgtcctcatttttcaatatcattatctggagtacaagataatgtaataatttttatttcactaataaaatatggtttatagaattcataaagaaaataatatattattatgtatctatattccatgtccagttttttatttctttctgatctctaagatctttttcctttattatttcctttctgttttaagaccttcctttagccaggctttaagagtaggtctactagtgacatatcctacatatccttttagttttcttatgtccaagatggtctctatttcatcttcttaccttaaggataatttcaccagttatagaatctgtggttcagttttttttccttaaatatcatttgaaagttttgtgtcattttcttttggtttccaaggttttggatgaaaaactcactgccatttgaattggggttctcttgtagataacatagtttctccagctacattcaagccttttctttgtcattaattttcagaagattaattatgatgtttcttgatacagatttctttggatttattctatttgggattcatttagatatttaaatttgtaaagtttatatattttgctaactttaagaagtttttatccattatttctttaagtagaaatgttgaatattttacttttctgtatccctaaggctctgatcaattttttgggggggcgcggggcggggggttctgtttgctatctgttattcagactgggtaaattttagtgattagtcctcaggtccatggattctattctctgtcatctctgttctactaggaagcccatctggcaagtttttttaatttttattatattattcatacctgggtaaatttgatttggtcttctttgagtaacttctatttttctgctgagatttgctagtatttgtttcaagagagtttataattgcttattaattcaattttatgatagctgctttaaagtcctcatcagatatttccaacatctgtatcatttcagtgttggcttcagttgattgtgtttctcaggttgtgattttcttggttcttggtaagataggtgattttcaattgtattctgtgcatgcctgttatatctattatgagattctggatcctgtttaaatttcctgtttcagcaggtatgctttctgtttagatttagcatgcaaataaatcttagatgagcctttgtagtagtattttgttctacttggtttatatggtgtgtctggggctcctgttggaccttgctggcatcccgagggggcagaaagttctttctcaggacggggcatatggtctctccaggtggcggaagtgattctccaccatggagggacaacaagtcttcccaagccaggtggcttgttgaggcaggatcccatttgcctgtactttctgaccacccagtgtccctcaagtgacagaagagattttcatgccttgtggggatagaaattgcttaccagagtgcttgttatggagggatccccttgccctttccaatactgtctggctgcctgctgtctcctgagggcaaggggagtttcagacctgtgagaccaaagttgtctccaagattggacaccccaccatgtcttgttctttcagtcctcagtccctaacaaactcacctttgtcctcccatctttcagaatacgccttttgttgcatcttgcactatttccaggatttatagttagacctagaggggagaagcagggaaagccaagtctataccatgttgtccagaccacatgcctccttcaactcccgctaaattcgaagaagtaacacatttagaaatgttatatttcttgttgaattgatctatttatcattttaaaatatgtttcaatctttactaatgattcttgccttatactttttatattcttggagcactagcattcactggttagtgtttgcctcgtatatgtttttccagtgtactttaaaacttcctatctctttataatgaatttgtttctcttgtaggcagcttgaagtttggttgtatatttcaccaaattgacattatttgtcttttgattagagtttttagtctatttatattatttgacttaatataaatctaagtacagttaagtctaaatcaccaatcttgccatgctttctatttgtcatcttttatttgatcaatccttttcttgcatgtttgtatgaagtaaatatattttattccttcatattttttcaatctgttagcctgttaatcattattattaattcttatttttattagtacttaccttcacaattactatttgcatccctgatatagttgagtgctattgtgcaacctggcagccactggctacatgtgattttggagcacttgaaatgtgctagattgaattgtgctgcagatgtaaaatacacactggatttcaagtatttaacactgacaaaataatacataatatccagtattaatttttgtatctattaaaataacattcgagatagagaattaaataaaatatgttattaaaattaatttcattctctaaatttttcattctctaaaaaatttttagtgtagctattaaaatttctgacttcacatgtatgatttacatcgtatttctattggaaagtgttccattgtattctaccttaaatcagtgtctttactgctctgtgaatcataaaaagactttaaaacattttaactgcattgagactccttttctctcatattgcttcagtaaaatattttaattttacatattttaaatccaccagataatattaatactgttttaaacagccaagcgttatgtacatttactcacatattcaccctttttactactactgcttattctattttactgggaaaataatttcctgggaaaataatcatggatcatttttctgcaagagcttcctttagtaatttctttagtgtcatttttatcataatgaattttttagtgattgcctgaaaacatctctttttttccccttcacttttggaggagattttcactggatgaaaatttctacatggtcagctatcctttcctcattaaaaataaatgtcattatattgcctcattttttccatcacatcttttgaaatgttagcttgtcagttttactgttgcctttttgaaggtgtacacattgttcaatgattacttcgacaattttatctttgtctctattttttagtagtttgcatatggtatgtgatggtgtcagaaattttttcatttgtcttgtgtgaggtttgcagaacaatctgtttattattttttatcatttttagaaaatcctttgctaaacatctcttcaaatattgctccttccccattctctttactctctgatttcagatgctaattacacatatattagaccttttctctgtgcttcatatgtgtctactctttttgttattttcctctttgtctttctttggttcaatatggatgttttatgcttaatcatcttcagttcatgaatcttctttcctgctgcatctaatgtgtattcacctatctatattgaaactttttgtcattaatccttactatcacttatattgcttttaatatctagaatttctgttttattattttatatattttaattctctggtgaaattttcattttttcatccctttaattgaatatataataataatttaagtattcatagactccgatatatagatcacctattggtctgcttctgatgtcttatagtctctcgggttttagttatttgttcttacttcttggcatacttggtaaatctcaatatagtacaggatgatttgtagaaattctgaattaaatttctttgctctatagaaaagaatttaatttatacttttagtcatatagagtataatcagatatttactttcagttcacctttactgctatagtatatcctttccagagtcccatgaaaaagcctgagttatgtctcagggcctctcctctttggcaagcccagaactgtattttttatcttcccagaatcaccaaagttctgaaatatctgcttagctttttactctgttgaagccacttgatgcttaattttgcagattcttgccctgttgtgtgtgcaatttaggaatcagtattgaggggaattgcgtgcaaagtgttgacagctcgtctccatgaaatttccatttcattttgatcccaagcccttaagtcctggatgctgtggtaacattcaacatcagtttaagtgtgtgtgggccagagagactgccagatgctgtcattcacgtttttttgttcagattctctcctgatctgaaagtctacaagtgtcctcagagaaaaaacctggtgttagtctaatatttatctcatgtctttctcttttttctgggactttggtcctttgatgtatatctgtgttagtttttttctgatgcttttaaacaactattcctgcaattgtttcagctttcttgttattatagatgggcaggttagtcaaacagcaatgactttgttactgctggtagcagaattcagccctgaattctcatcactgaagtttggttctgggatagtggagaaacttaatatgctctatatagttggtttggaatctccctagaatttttgagaaattagcaccttttattctctgttttagggcctcagatgaagttttaatactatataaaatatcttattcgaaatgttctaagcactgtgaagagcacagatgcacttggtaaaagagatgagccaaaatggaaccttagggagcttaactcgcatctaagaaagttaataataattatatgagagtagtaataattattatggctggtttttattgaatacttacaatattatagtaatattccaagctttatcctaggtacattttatatgcttatgcactgaactcacaacaacgctttatgttactcactgttatttgtcctctcttataggtgaccaaggccagggtggttaagtaggttacccaaggtctcacagagagtaagtggcaaagccagtggaagatatcagagcagagattgttgttgtgaaattgaaaatgcaatgtattttaaatttcacaacagatctccatctactaaagttaaggcagtcattgcttcacaacaaggatacaatctataagaaaaaagccagatagttttggcagaagtcagttacatgaaccaaatgtcagacagatttggtaaaagtcagactcttgccctgtctactggagcatcatctggagaaggtgcatgttctcagaagtctcattttcagaagagtcatgatttttcataagggtgtgggagtaggagggatggctgaagaaggtgtctagatatgtatatctgaagaagaaagttcttaggacctaatagacttcactataaatactatactatactatactatactatactatactatactatactgtactataaagcaagacaagatgctgacttttcccaaaaggacattccaagggcttagtggtacttccagaagctgagccaggcccaagctgccctttgagcaatgttaatccatcactgtgtggttcgctattgtcattcttctggaactgtgcaccagttgctatggctctgtttatgcctctagtcttcctctcctttagtgggagagactgcaaagttacatgtcaaagggtacaaaatacatagaggagcgaagactttagaaaataatatattctatcacagtgagcaccccggagcttagctttggagatcatggaaaaggatgaggggtaaaagatactcaaagactatctgtgccaaaaggaccactttgagataaaatgtggctgtgataataatgtttgaatttaacaggaaattcaaagaattgaactagaaatataaagataccttatgtaatatatatatatttgaatatgggggcacttgtaggatggatgagtggttaccaatttctgcattacagagtatcaaacagaatggagaggaggagacagacaaaaaaaagatgacctcagggttgtagatgtagggggtttgaacaaggcgcagctgaagatgatgctatttttcagttgagtgctgggattctaggaatgagattaacaaaatcaagagaagaaagaataattttggagagaattatcagctcactagggctctatcacaattgtgtttctactaatttcccatatgtttccaatctctttttggaaatgacattttttctaggctgttccatgctccaaacatatttgaccgaacctgtcctcctggctttgtcctaaccatgcaccaaacctcaacttaaacatcactttctctgggatatgtgtgttgactccatatataggatggaatatcttggtttcacccagccctcctctttcatgacatttttccttttttttttttggtaacaatttttttttaaaatagctgttttcgccacttaaatgtaatatgaataatattttatccacttgtcttttgattgtaaaatgagcctatatgtaattcctgacttttgagtgttcaaaagttcacaagaaaacagcattgtgtaaagaaaagtagataaacctcaaacttaagacagaatccattctgctgcccccatgctagccattgctggccaacaacagccttttccattggagcaaagactgttaattttttaaatgttctctatataaaaattgataattgactgaactatcagtgtgccataattaaaaagaaaaagcaatgaagaaatctatatagtaagtatatagtaagtatatacttactatatagtaagtatatagtaagtatatagtaagtatatacttactatatagtaagtatatagtaatatattagggttctccagataaatggaaacaataggatatgtaaatatatatatatcataaaaatgatacagacatttgagagaggacttgttaggagagatgactcacatgattatggaggctgagaagtttcacaataggtcatctgcaaactggagaatgaggaaagccagtagcacactgagtccatgtctgaaggcctgagaagaagccgggaagctggggagcctctggtacaagtcccagggtccaaaggctgttgaacctggagttctgatgcccaaggatagaagctgggtgtcccagtttcaggagagagggagagaattcaccttctttgtgcctttctgttccatctgggcttgcagccaattggatgatgcctgcccacattggataaaggcaggtctttctcagtcactctgtttgtttaaatgacaatctattctggaaacagtcacagacacacccagaagtaatgctttctaagctatctggatatcccttaattcagttaagtcgatacctaaaataaaccatcacagggagtaatctttgaaatcaattatttgcctaattttgaaaaaaaaagagatacactcaaagaatcaaccataatctaatacaaatggttatctcataggcaaggagaattggataaaaaaatacagggatgaaagcaacattttactgaatatacttttttatatagtttggacttctgtaaatattttccatgttcaaaaagcaaaatttagttaaaaagcacacctcgaaattgaaaacagaaacaaatgaacctacatattaatatggtgaaatgaatatataatattttaagtagtaagtttaaatatagtgacctgaccatatacactttttcagtgtttatatcctatagaaaaattaaaaaactacaaaaaagttttaaaatttacttatattattgtaagtagtaatattgacatgataatttttaaaactttgaagttaagttcatgttttagagaataattttagatcataaatgtagaagaaaaaatcagaaataccatcattttttaatattcataaaatattaaattaagtcagaaagtacccatggttactaattcataaaagtttctggtgaatagaattcttttagtgtaaaaagcaaataaaatgtgtgcaaatagcttgatcattgcaaaaaagaaaaaaatatattttaattgagagattaatgttactactagtgctatatctgaataatagttgcttctgcatatgatacagtaggaaggataacttcacttggaaattactcttgcaacaaatgttttaactaaattgaatcaaatttttagacctaaatttcattcaggaaatacatgggctagagcagtattgctcaaccttggttgcctatagagatcacccttcagctttaaaaactactgatgcctggattctatcctgaggattctgtagaattggacaaatttgaatgtggactgagtatttagagaattattctttaatgagctgtgatcatgatatcatgattctatttaaatgagaaatctgttccgaacaccaaaaacattgaggttagtggcagctttttagtccatattttatatcaatttgagataatatttttgaacattgtttcaaaacactaggtttaattaagaaataattaaagacttttctgattcctttaaagtcatcagtttcttttttcataataatgaccactatctgtgggtatgtaattcattttacttatatatgtagtggcttccacttgcctctaaccacaaaatagtaaatgaaaaccaatatcacattcctggagggattgcagagattagtgtcactgtctaggtcttgaaagatgcagagacagtgatttctaccacatcccaattcaacttgcaggtgaatcttgggaaatgattgaagaaaatagcagttgctattccagatgtggttttgctgtgttagaaaagtaatgcagcctctggtatctgacacactgttctgtatcctgtgatttttttttctctatatatctgctgagaaacatcaccagaagaaattttcttttcagctagccatgtcttcatgggcctatctgaggagtagatcaactcttctgccttattcataatttagttgccttttcttcgataagacataatgttggtccattacattgataacattatgatgataagacatgctggattagtttaagttacaaaagaagaaatgcttccattaggggacacaacaacgattccattaaactagcagttaagaccgacacctggccgcttaggtttctcctgcttgtgaatcaacagacaaaggaggaggtactgggctgactagggtgattgacactaggtatcaaggagaaattaggtttctgctacactgctgaggtgagaaagaatatgtccaaaataaaggtgatcccctaggtcacttcttagtattcctatgtgctataattaacatgagtgaaaaaaatggagcatctttcagacaaaacatctaatagcccagatccttcaaatgtgaaaaattgggtgaccgcatcagacaagaaatgatgaccagccaaggtgtttgctttgggaaaaggaaatatgaatggtgagctgaagaatatagttatacatattagctatgacctcgtgactggatgccgaaatgagaactgtaacagttgtaagtatatcctcttgatctcaatagaaaaacgtttataataacataaaaataagctagtatattaaatcctaaatcttgagaaagtgtacctgtaatgacaaattgagccagatcaagcacttatgtcatcctccatccagttaccccagggttattcccacacatggcccacaggctcttgtcaatcttttcttatgggactttgtatttttctcctgaaagaatgttgttgtctaattctcattataagttggaagctatacgaaatggaagggttaactgtggcatgtgtatgaggcttttcttgcattgctataagaaatacctgggactggtaaatttgttttaaaaagaggtttaattggtttacagttctgcagtctttacaggaaacatgagactggcatctgctcagcttctaaggagaggcctctggaagcttacagtcattagctggtacctcacatggcaaaaacaggaacaagtcagcaggtgggtggggggggtgccacacacttttaaaagaccagatctctcgtgaggactcattattatgaagacagcactaagccatgaaggatccacccccatgatccaaacactttccaccaggcctcacttggaattacaattcaacatgagatttggacagggtttaatatccaaactgtaacattccacccctgccccctcccaaatcccacgtccttctcacattgcaaaatatagtcatgccttccccactgaccctcatagtcttaactcattaatggaaagcgttaactgaaaagtccaaagtctcatctgagacaaagcaaatccctttcacctatgagcctgtaaaataaaaaacaagttagttacttccaaggtacaatgcgcatataggaattgggtaaacatttttatttcaaaaaggagacataagccaaaagaaaggtgctacaggccccatgcaagttcaaaacccagcagggcagttactaaatcttaaagtttcaaaataatctacttttttcatatcccatatccagggcacactggagcaaggtgggggtgggggggctcccaaggccttgggtagccccgcttctgtggctttgcaaggtgcagcccccatggttgcttttacaggttgttgggtgccttgtgacttttccaggcacggggtgcaagctgccagggctctaccactctgaaatctggagaatggtgacccctttcttatagctccactatgcagtgcccctcaaggattctatgtgggggctctgactccacaatttccctctgcactgtcctaatagaggttctctgtgggggctcacctcatagcaggcttctgcctgggcacccatagttttccatacatcctctgaaatctaggtggagggtgtcaagcctcattcattcttgcactctttgcacccttaggcttaacaccacatggaaaccactaaggctcatagtttttgccctctggagtggcagcccaagctgtagctgtacctgggcacctttgagccaagactggagctgacacagcgaggaagtggggagtattatttcaaggctttgcagggcagtggtgccctgggcctgtcccactaaactatcattttctcctaggcctatgggcctgtcatgagagggctgcctagaaggtctatgaaatgccttccaggccttttcctcattgtcttggatattagcatttgactccattttagttatggaaatatctccagcaagaggttgctccacagcttgcttgaattcctctcccaaaagagctttttctttctctgccccatgaccaggctgcaaatttaccaaacttttacactctgcttcttttctaaaataaattgcagctttaggtcacttatttgctcctgcatctgagggtaggttgttggaagcgtccagaccacatcttgaatgctttgctgcttagaaatttctttcagcccctaggttatcactcttcagttcaaacttccacagattcctagggcatgaacacaatgtagccaagctctttgctaaggcttaacacatgtgacctttgctccaggtccctatgagtttctcatttccatctgagaccttggcagcctggattttactgtccatatcactatcagcattttgctcacagccatttaaatagtctctgagtagtcccaaaatttttcttaccttgctgtcttctgctgagtcctccagactcttcctatctctgcctgttaaccagtttcaaagctactttcacattttcaggtatctttataacaatatcctagtcctattatgattttttttttgtattgggtaattcttgcattgctataaaggaatacctgagactaggtaattcataaagtaaagaagtgtaattggctcacagttctgcagtatttacaggaaagcatggtgctggcatctgctcagcttctaagaatgcttcacgaagcttacagcaatgttggaaggcaaaggggaaaccagcacatcacatggcaaaagcaggagcaagtgaaagagagggagagggagaaggtgctgggtgggggaaggtgccacacaactttaaatgacaagatcttgtgaaaactaactgtcatgaagacagctccatgccatgaggaatctgcccccatgatccaaacatctctcagggggcctcatctccagcattggggattacagagcaataagatttgggtggggacaaatatttaaactatatcagcctataaactaaaaataaaatcctaagcccccaaccaactgaacagatttcctcttggccataggaatcccagaaaaaccttaaaaactgaattcctggctgtattagtctattttcacactgctgataaagacatacctgagactggttaatttataaagaaaagaggtttaattgactcacagttccacatggctggggtgccctcacagtcatggcagaagacaaagaaagagcaaaggcacatcttacttagcagccagcaaagagaaaatgagagccaagtgagaacaagagccaagtgaaaatgagagccaagccactcttataaaactatcagatctcgtgagacttattcattatcacaagaacagtatgggggaaactgcccttatgattcagttatttcccactgggttattcctataccatgtgggaactgtgggagctataattcaagatgagatttgggtggggacacagccaaaccatatcattccactcctggcccctccaaaatctcatgtgctcacatttcaaaaccaatcatgccttcccaacagtcccccaaattcttaactcatttcagcattaactcagaagtccatagttcaaagtgtcatctgagataaggcaagtctcttccgcctatgagcctgtgaaataaaaatcaagttagttacttcctagatacatgggggtacaagcgttgggtaaatacagccgttccaagtgggagaaattaaccaaaagaaaggggctaaaggccccactcaagtccaaaatctagtagggcagtcaaatcttaaagctccaaaatgatctcctttgactccacatctcacatcacgctgatgcaataggtgggttcccatggtcttgcccagctctgcccctgtggatttgcagggtgcagcctccgtcctggctggtgtcatgggtgctcattgaatgtctgttgattttccaggcacatggtgcaagctgttggtggacctaccattctggggtctggagaatagtggccctcttctcaccactccactaggcagtgccccagaaggaactctgtgtggaggctctgaccccacatttcccttccacactgctctggcagagattctctataagggccctgcccctgcagcaaacttctgcctgggcatccaggcatttccatacatcctctgaaattgaggcagaggttcccaaacctcaatctttgacttctatgtacctgcatgctcaataccacgtggaagctgcaaatgcttgagcttgcaccctctgaagcaacagcccgagctgtactttgaccccatttagccatggctggagtggctgggatgcagggcaccaagtccctaggctgcacagagcagggggaccctcggcccagcccacaaacccatttttttctcctaggcctccaggcctataataggaggggctgccatgtagacctctgacatgccctggagacattttcccaatggtcttggcaattaacatttggcttctcgttacttatgcaaatttctgtagctggcttgaaattctcctcagaaaatgggtttctcttttctattgcatcagcaggctgcaaatttgctgaaattttatgctttgtttcccttttaaaactggatacttttaacaatacccaagtcacctcttgaatgctttgctgcttagaaatttatttcatcagataccctaaatcatctccctcaagttcaaagttccacaaatctctagggcagaggccaaatgctaccagtctctttgctaaaacataacaagagtctcttttactctagttctcaacaagtttctcatctccaactgagaccacctcagcctggagttcattgcccatatcattatcagcatattggtcacagccattcaaaaaatctgtaggaagttccaaactttcccatactttcctgtcttctgagccctccagattgttccaacctctgcctgttacccagttccaaagtcacttccatattttcaggtatctttatagcagtgccctgctctatcagtacctatttactttattagtcagttttcatgctgctaatacgacatacccagactgggtaatttataaagaaaagaagtttaactgactgacagttccacacagctggggcggcctgacaatcatggaagaaggtgacggaagagcaaagggacttcttaatggtggctggcaaagacaaaatgagagccaagcaaaaggggtttcctcttataaaaccatcagatctcatgagacttattcattaccaagagtataatatgggggaacctgcccctgtgattcaattgtcttccactgagtccctcccatgacatgtgggagctacagttcaagatgacatttgggtggggtcacagtcaaaccatataactggccatgatgggaagagaggtcagacatgcctttatctcatcccttttggagtttaggcacaactgaccagcatgaatgtcaaaatagatattacaagactgacaaaaaagacttttgtggcaacaaaatatcaaattataaacaaaacctaaggcaaggcaaggcaagcattaagtcttgcctgcaggcaatcagtcttattaaataggtcatattacggctgactctaacacaccatccttatttgaacttaaacattcctttctgttaactccaagtttttagacaaatctttgttcctttaaccaatttcagattaacaaatctcaatccatctatgacttgcaagaccccacttcaagatattccaccttttcgggcaaaatcaatgtatacctttcatgtattgatttatgtctttgcctataactcctgccttcctgaacttatccagtaatccagctgcctcagaatcacttattcaaggcttcttgggtttgtgctttctccaggtgatggtcactcataatggctcagaataaacctctttaaggtattgtatagagtttgtttttctccattaactggaggataatagaaacctctttatgaggcaccttcttgggtgacgttattactcaaagtttttaagcacaagacagcctgtctccagactgagagagagaccgcttccattagttaggttgtccatgggtattgacttttagcatcccattttccaacaacaatgaagtcatcattaattcaggtcaaactggtgagccttcaaatttttaaatcttatctcaaaggtctgtttcatgagctcactcttggtacccagctgctgtcagccaaggtaaagctaagagaacaaaaaatctattcctggagtccaagagaggaaatgtaatgtgaggaactgcttatgaagttgtcaaaagagataaaaatgagaaagtaaggcatctcagagattaataatgactgattaacaacttacaaaataataacacaaatttttgtgttagggctagagggtcatctgggaaaaaatggggttactatatgacaggagctggaactgcctggtaggacagagaagcatggtggaaaggataggtgatgagggctggagctgtgaagaagctgcctggaggaagatgagatgaagtaaagagacatcccagtaggagattaaatcacagaggacaactattaggctggtgcaaaagcaattgtggttttggactatgaattttcaataattataactaagctcaaacacatcattattaatcaaaataggaaccattacaatcaacacatttttgacaatgagaagtaagttggtttattcctgtagtgtaaaaatccatgctttgggattcaatgaactctaggaaagcattttctgcattctattggctgtggaagcattttccctgcaaaaagttgttgagatgcttgaagaagtggtagtcagttggcgagaggtcaggtgaatatggcaagtgaggcaaaactttgtagccagttcattcaacttttgaagtcttggttgtgcgacatgcggtcggtgttgttgtggagaattgggccctttctgttgaccaatgctggctacaggtgttacagttttcagtgcacctcatcaatttcctgagcatacttctcagatgtaatggttttgctgggattcagaaagctgtagtggatcagaccagcagcagaccaccaaacagttgccatgaccttttttttttggtgtaaattttgatttgggaagtgctttggagcttcttcttggtccaaccactgagcttgtcatcaccagttgtcatataaaatctactttctgtcacttgtcacaatctgatagagaaatgattcgttgttgttgtgtagcataagagaagaagacacttgaaaacgacaatttttttgatttttgctcagcccatgaggtacctacttattgaacatttttacctttccaatttgcttcaaatgctgaatgaccttagaatggttgatgttgagtttgtcaggaacttctagcatagtcgtaagaggatcagcttcgatgattgctctcaattggtcattgtcaagttctggtggctgtccaccacactcctcatcttcaaggttctcatctcctttgcaaaacttgaaccaccatggcactgtatgttcattagcagttcctgtgtcaaaagcattgttaatgttatgagttgtctccactgctttaggacccattttgaattagaataagaaaatcacttgaaatcgctttttgtgtgacgttatttccatagtctaaaataaacataaaataaacaagaaattggcaaaaataaataaataaataaataatacagcgagaaatgcccaataaaatgttgtataacataaagagatttatttaataatgtattccaatatcaaatgacaaattccaacaatgcaaaaaccacaattacttttgcactcactgagtagatgtacctaggagtgccatacaaagaggagggagagagtaggaacagctgagattctctcttcctcctgcttctagtctaccatcctactctccactgaccaaacctgcctaaaaccagtagacaacaaacctggggaacgtaattcttatgcatctaccccttaaattgcagagcacagcaatagaaatgtacaaagtgaatctgaaagtaaacaaatgcggacctaatagacatctacagaactctccaccccaaatcaacagaatatacattcttttcagcaccacaccacacctattccaaaattgaccacatagttggaagtaaagcactcctcagcaaatgtaaaagaacagaaattataacaaactgtctctcagaccacagtgcaatcaaattagaactcaggattaagaaactcactcaaaaccactcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcattaaatgcccacaagagaaagcaagaatgatctaaaactgacaccctaacatcacaattaaaagaactagagaagcaagagcaaacacattcaaaagctagcagaaggcaagaaataactaagatcagagcagaactaaaggaaatagagacacaaaaaacccttcaaaaaattaatgaatccaggagctggttttttgaaaaagatcaacaaaattgatagaccactagcaagactaataaagaagaaaagagagaagaatcaaatagatgcaataaaaaatgataaagggcatatcacagaaatacaccgatcccacagaaatacaaactaccatcagagagtactataaacacctctgtgcaaataaactagaaaatctagaagaaatggataaattcctcgacacatacactctcccaagactaaaccaggaagaagttgaatctctgaatagaccaataacaggctctgaaattgaggcaataattaatagcctaccacccaaaaaaagtccaggaccagatggattcacagccgaattctaccagaggtacaagtaggagctggtaccattccttctgaaactattccaatcaatagaaaaagagggaatcctccctaactcattttatgaggccagcatcatcctgataccgaagcctggcagagacacaacaaaaaaagagaattttagaccaataggcctgatgaacatcgatgcaaaaatcttcaataaaatactggcaaaccgaatccagcagcacatcagaaagcttatccaccatgatcaagtgggcttcatccctgggatgcaaggcttgttcaacatacgcaaatcaataaatgtaatccagcatataaacagaaccaacgacaaaaaccatatgattatctcaatagatgcagaaaaggcctttgacaaaattcaacagcacttcatgctaaaaactctcaataaattaggtattgatgggatgtatctcaaaataacaagctatctatgacaaacccacagccaatatcatactgggtgggcaaaaactggaagcattccctttgaaaactggcaggagacagggatgacctctctcaccactccttccaaccttgtgttggaagttctggctagggcaatcaggcaggagaaggaaataaagggtattcaattaggaaaagaggaagtcaaattgtccctgtttgtagatgacatgattgcatatctagaaaactccatcatctcagcccaaaatctccttaagctgataagcaacttcagcaaagtctcaggatacaaaatcaatgtgcaaaaatcacaagcattcttatacgccaataacagacaaacacagagccaaatcatgagtgaactcccattcacaattgcctcaaagagaataaaatacctagaaatccaacttacaagcgacataaagatctcttcaaggagaactacaaaccactgcacgatgaaataaaagaggatataaacaaatggaagaatattccatgctcatgggtaggaagaatcaatattgtgaaaatggccatactgcccaaggtaatttatagattcaatgccatccccatcaaggtacccatgactttcttcacagaactggaaaaaactactttaaagttcaatatggaaccaaaaaagagcccacatcgccaagtcaatcctaagccaaaagaacaaagctggaggcatcacgctacctgacttcaaactatactacaaggctacagcaaccaccacagcatggtactggtaccaaaacagagatatagatcaatggaacagaacagagccctcagaaataatgccgcatatctacaaccatctgatctttgacaaacctgacaaaaacaagaaatggggaaagaattccctatttaataatggtgctgggaaaactggctagccatatgtagaaagctgaaactgaatcccttccttatatcttatacaaaaattaattcaaaatggattaaagacttaaatgttagacctaaaaccataaaaagcctagaagaaaacctaggcaataccattcaggacataggcatgggcaaggacttcatgtctaaaacaccaaaagcaatggcgacaaaagcgaaaattgacaaaatcgatctaattaaactaaagagcttctgcacagcaaaagaaactaccatcagagtgaacaggcaacctacagaatgggagaaaagttttgcaatctactcatctgacaaagggctaatatccagattctacaatgaactcaaacagatttacaagaaaaagacaaacaaccccatcaacaagtgggtgaaggatatgaacagacacttctcaaaggaagacatttatgcagccaaaagacacatgaaaaaatgctcatcatcactggtcatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaactattgtggaagtcagtgtggcaattcctcagggatctagaactagaaataccatttgactcagcaatcccattactgggtatatacccaaagtattataaatcatgctgctatagaggcacatgcacacatatgtttactgtggcactattcacaacagcaaagacttggaaccaacccaaatgtccaacaatgatagactggattaagaaaatgtggcacatatacaccatggaatactatgcagccgtaaaaaatgatgagttcacgtcgtttgtagggacatggatgaagctggaaaccatcattctcagcaaactatcgcaaggacaaaaaaacaaacaccgcatgttctcactcataggaggggattgaacaatgagaacacatggacacaggaaggggaacatcacacaccggggcctgttgtggggtgaggggagagggggggatagcattaggagatatacctaatgttaaatgacgagttaatgggtgcagcacaccaacatggcacatgtgtacatatgtaacaaacctgcacgttgtgcacttgtaccctaaaacttgaagtataattaaaaaaacaaacaaacaaacaaaaaaaacaaatgaccagcatgttgattttttttccttaaaacttgcagtgtaaaggataaaccaaattggaagtgacattttctataccaggtcaatgtcttttctcagtaagcatgcatctccttgactactgtattcatttttttctgtagctgcgtaaaaaattaatgggttgaaacaacatacactcatctcacagttttagtgtagcagaatctgtgcatggcttagctggatcttctgctcagcatcaaacaagactgcagtcaaagtgttgtttgggctgcagtctcatcatcagtttgactgaggaaagagccccttctaagcttcctcaggttgtttgcagaattaatttttctcgcagctatggaactcacgatgtcttcttcaaggccagcaaaagtgcttctcttcaacacggacctagtctcttgtagggcttttcaactgattgtcagattcattcaggataatttcccacttgattaactaaaaatcaatttatttgggaccttacactacatctgaaaaatttctccacctttgccatggtacataacctaaatacaaggaatgaacttttattctaatcattcccaaatagaaggaatgatcttttattcaaagatcttgcccacattcaaggtggggaggattatgtagggtgtatatacattgaggggttgggggggcaagaatcatggggtcttctgagaattatgcctacctccagtgctttgtataatcttcatatttttcccacatatagaagtcatatttcagaagttccactgttgaatttttttctagttctgtcagttgacataattgcctttttttagaaaaggcaacttccattccatagtctcagagataatgataagaagcccagtacatggtgattgcactttctaattttattctaagtttactggtaacagattatatcatcagaattgaagaaacaaatataatgtactgctgagttattcagttactgggaggagataatagtatttctaatgattgatgaatgaagtcagcaaaactagaggtgagtatgtggtaaactggaagcgtagaacaaaacatttaatttattaccttaaggagcttttattttatgaacagtggtcccttggattataaatctacatttatgggctctccaaagagctgtcaccttagaatagaaagcactgcagtccacagagtgaagatcagcgtctttacagaactgatggtagatagatgctcattatttgaataatccatatgcaagactctagaaagtggtgtggggatccctattttgggaagctatacattataacaggtatttttaagggccaagtttgtggtcatggctctgagactcattgctgggtgaatttgaacaattttcttaacctctttaggacagcttctttcatctataaatgaattggtggattctaaagttgaaggctccaacattctatatgtcttaaaattatagtagagatgctatttaggtgccttagaatttggaatccttgcttttcgttttttaaaaggagaaggatttcaagtgcatggtgtgttgtcagctgggaaaaagaaaacacagagaacacaaaacgtaagaccctcattaactagatggtaatacacatagcccttattgttttcatgtcataaagaaaaacctcctcagtatggctttgaaacctttcctgtttttgttccctcctgctgaagcaacaagagcccttgccttactttatgtatttcatatgtcacatcctctcttgattttgactgaaagatacattctcagtttcttaatctgacacgctatttcccctttaaggtggaagccagaatgtctgtgacatatcctccactcctccttcccctaggctgtagagatcttcccagcatttattgtgcaggcgttgcctgtgtcattgcaagttctgtagtgacatcatcctgtttctttgaggcagggaccttaattgttgctattggcttaaatgattaagtgaatgtatatattagactttaccctacatttaagtattccaggggtaagataaaggggtctcccttctctctagtaagccataggctttcaataatagaattttaaagaatagcattgccatagtttgagtatgtcttctaacaatcatgtgttagaaattgaatccccggtgaaacagtgttgggaggtggagctaagtggaaagtgtttggatcataagggcttcaccctcatgaatgaatttatgcccattgtaaaagagcttgagactgccagttggttgttttgctctctttttgcccttttatcatcggatgacacagccagaagtccctcacaagatgtgggctccctgacattggacttcctgaccttcagaactataagaaataaatctgttttattataaattacccagtgtcaggtcttctgttacagcagcacaacatgaattaaaaacaaatatatgcatcactttttaatttaacaaatatgtaacacttattgtgtagctggcattgttctacgcactacacacactaatttaattcttataacaactctatgaggtcattgctgttattgtctctgttttatggacaagagctgaggcacagagaagtaacttccccagtgatcttgtttgtctcataatgaaaaccagtgttttcttttttccccagcgtttaaagtggtctgtgtagtaaaacaatttttaaaaagagaaacacaatcattgttttttcctctagaatgtccaactgaaaagtagttgtttttaaatcaattaggagattctagttttgaagttgagccctattgttgacaagaagggagcactaaaggaaacccttgggactagccccataatgttggctctctctagttttcacacagaaagataactcttaaattaaaaaccagttactaatagagcaaaacgaaaaggttgagacagcatgacacagaatgggcaattacttttagaggactttttctccaatatttctaataaaatgggacatgtttcctcaatgctgctttgaagaaaatattgctaacttaaatataacttaaatcacaataataacaatccatgatagaggaaagaaatcgcacttttctagttttcttttatttgcatttaatagtgtggcaaagctttagagaccttttccaagattgctttagcaaatttgtgcctttgatcaaacacacaccataccacacacacagacacacacgcacgtgcacacacacacacacacacacacacacgtctattttgaaatccagttgctttaatggtcatcataatgatgctgtctatactcagcttctcaatacttcttttatgaccaagaactagacaattgtcaatacagaaaagtcaaggaggtaaaccatgtgacaaaatgtaaacaggtgttcaataacaatgtcttatgaaaatgactggtgttagaacagcagaaggatttgagatcatctgaggtttacatctctatgggccctcttgcctatctgggggctaggcttatgggggacatgcaataatacatttattcaacaaataaatttgtgagtgtgccaataaaaaactaaggcctggccgggtgcggtggctcatgcctgtaatcccagcactttgggaggcagagacgggtggattacgaggtcaggagatcgagaccatcctggctaacatggtgaaaccctgtctctactaaaaatacaaaataattagctgggcgtggtggcgggtgcctgtagtcccagctacttgggaggctgaggcaggagaatggtgtgaacccggcaggcagagcttgcagtgagccaagattgcgccactgcactccagcctgggagacagagtgagactccatctcaaaaaaataaataaataaataaaacaaaacaagacaaaaaacaaacaaacaaaaaaaactaaggcccagggaaattaaacaacttaatatcatgcaaatatgagacagcagagagaaacactgaatctaggcattctgtcttcatataccacattctttcccatactccttggctattatttttacacagtgcagatatttattttgttttttaaaataatatataatgccactatttatggagtataaatcaatttggctattacatgtttgcctaaaagaatttctgacatttattttagtacaaaaatgttcctaaatagcaaataaatttctgttattattttgttagaattcttttggtgtacctatttgcttctccctcaaaagtgcacgtctgcaagaatacttgtgcaggcagtccagggtggacagaaaggtctgtgggagaaaaaaatgtaaagattgaacctgaatatggattttgaaattgatgtgctttaccaagaaatttcaagaggagagaatgtatgcctttacagaaccaataaaatgattatggtatttattttcctttgccaattattgattcattagttcatattaatagatatcttaatttaaaagtattggggagttctccaattataccctaaatgatcaaagcataatacatgctgatatggtttggctgtgtctccacccagatctcatcttaaattttagttctcatgatccccacatgtcatgggagggaccccatgggaggtaattgaatcatgggggcggttatccccatgctgttcttgtgatagtgagttctcatgagatctgatggttgtataaggatcttttcctcctttgctcaacactttctctcctgctgccatgtaaagaaagatgtgtttgcttacccttctgccatgattgtaagtttcctgaggcctcccaagccatgcaaaactgtgagccaattaaacttcttttctttataaattacccagtttcaggtatttcttcatagcagtgtgagagcagactaatacactaaattggtaccacagagagtggggtgcttctttaaggatacactttggaactcggtaatatgcagaggtgtaatggtttggagggtgctgaagaagatgggaaaatatgggaaagtctggacctttgtagagacttattgaatgattttgaccaaaatgctgatagtgatatggacaaagaagtccaggctgaggtagtctcaggtggagataaggaactttttggaaactggagtgaagatgactcttgctatgcattagcaaagagactggtgtcatttttccccttccctagagatctatggaactctgaacttgagagagatgctttagaatatctggcataaggaatttctaagtggtaaagcattcaagaggaagcagaacataaaagtttgaaaaatttgcagcctaacaatgctattggaaagaaaaacccatgttctggggagaaattgaagcaggctgcataaatttgcataagtaatgagcagccaaatgttaatcaccaagacaatggggaaaatgtctccagggtacatcagagaccttcatggcagctcctcccatcattgattcagaggccaaggagggaaaaatggtttcctgggctcagctcagggccccctgctctgtgcagtcttgggacatggtgccctgtgtcccagctgtttcagcgccagccatggctaaaaggggccaagatacacctcagaccattgcttcagagggtaaaagccccaagcctcaggggtgtttacatggtttcgggtctgcaggtgcacagaagttaagaattgaggtttgggagcctccacctagatttcagaggatgtttggaaaagcctggatgtccaggcagaagtttactacaggggtggagccctcatggagaacctctgctagggcagtgcaggagggaaatgtgaggttggagcccccacacagcatcccccctggggaactgcccagtggagctgtgagaagagggccaccgtcctccagaccccagaatggtacatccactgacagcttgcactgtgcacctggaaaagctgcaggcactcaacaccagcccaagaaagcagctgtgatgggggctgtatcctgcaaagccacaggggcagagctgcctaaggctgtgggagcccacctcttgcatcagcatgacctggatgtgagacatggagtcaaaggaggtcattttggaaatttaagatttaatgattgccctattggatttcagacttgcattgggcctgaagtcccttttttttggccaatttcttctcttggaaaaggtgtatttacctaatgcctgtatccccgttgtatctagcaagtataatgactaacttgcttttaatttttcaggatcatagacataagggacttgccttgtcttggatgagactttggacttggatatttgggttaatgctggaaggagctaagactttgggggactgttggaaaggcatcattatgttttgaaatgtgaggtcatgagatttagaaggggctaggagtggaatgatgtggtttggctgtgtcccccaccaaatctcatcttgaattatagttcccataatccccagatgtcctgggagggacctggtgggaggtaattaaatcatggaggcagttacccccatgctgttcttgtgatagtgaatggattctcacaagatctgatggttttataaggggcttttctggctttgcttggcatttctctctcctgccaccttgtgaagaagaatatatttgctttctcttccaccattattgtaagtttcctgaggcctccccagccatgcagaactgtgagtcaattaaatccctctcctttataaattaaccagtcatggacagttctttatagcagcatgagaacagaccaatacacaagcctatgtgcattgtggacactgctcttactctgcacaggtctctggctcccacctgaaagttctgttcacacctcccttcattactatttgcttttgcttccaaagatcctttgcctgggacttgttttggagacctgctcttggactactagaacctcctggagctactttgtggacacaaaggaagcagaagtacctgcaattttatattcacatgagcaacccagagccagtgactaacttgtcaaagagtgtgaaaacccagctccttgcccagtcttgggacaaactctcagatatcacttatactccagcatctgcctgtaggatctagcctaacctttcctgcctgggactcagcctaaaattttccttactcttgaatgttttaatctttccatttcttttttccttcctctcttgctcatttttttcctgggagcacttcctgaataactcacttgcccaagaatctttgttttactgtttgcttctaaagaattggcctaaaatgtatactacatgatttgcaaatgttaaattctgattttagcctctgtatcaattttctaaaggggtctatatgtttcttctggaggctctggggagaattagttccttggggtttccaagtacattccaagtatctcccaacctctgcttccatcagcaaatctctcctgcctctgccttgcaaggatctttgtggttacgttgtgtccaccctgataattcaggctgatctcctcatcctgaagcctttaattaaagcaaatctgcaagtcccttttgctacataagataacatgttcataggttctggggattaaaatgtagaaatttgatggggtggactattctctttaccatagcaactcagaaagatgaccttctctgaaattttattaatctcctgtttgttacagtcttctgttacttatactcataagtgaaattgacctatcagaggtatttttgtgggtcagagttttgtataatattgttgttagtataacatcatttactgagaaaattacttttttctttggtctgaaactttttacattgcaaacaatgatcaatgtgaaaaaacatgtatttataaaatcaaaatgagtgtacaatgcttgaaagctgttcttaagattaaaaaaaaaaaaaaccccacaacacaagttttccaattattttcagtattttttccccatgaaagtttttatttcttctgtgccagttcaaagtcatttgcatagcattttataggatgtcatctattttctttcaaaatatactgcatgctcctattttctaatataatgctgtctttctttccttcttgattgtaaagtgcatggaatcttatttgttactatgcctttaaatgtcctagctcttaaatttataaattctgttatttacacattttctcttgcaaatgttttgaatgtaatatatttaggtttgctcatttttcctttgctagaattgaatatttagcatatattttctattaaatgataacttgttttagtttttgaaaatgagattattagtttcatgctgcccttcaacatttcattcaactatattttgctttatttggaatagctggagaattttatagatataccatatataactgatctcttattgctacacatcgatatactgttcaagttttttgtatcagaaaaagcactataataaacaaatttatattcacttctgtatgcttttatttaaatttccttagagaattttgacaaaaatcttgaaggagaaattgtctgggtgttttggggaaattgtctcttcctctttcctaaacacaaagattttacttcccattttagggcctctgatcagctccccacctccagtacggccccacaactcagcaagttttctttacagacatgtgtttgtggcctcttggattcccagtgccccactccatcactgtgtgagtggatttttgttgggtaacatttctccagcagagactctctgtgttggccaagtgtggcccttacctgtgccagaatcagcagatgccctagggaagacctggctagagaatgtcagtttctcttagaaagacatccctctctgaaattttaattcatttggtctttgttgcttattcattctgtcaaataacactgattgagcatctactctgtgccagagactaggaagtttttatgagtccagaaaatactttctagctcttaaaataatcaaagacaaagactaaaattactacagtgagaggtaagataagaagagtttcataagaggggccatggactgcttataaattggagaattccaggcatcagtgcacacatttgcatccaaatcactgtttctagtaaagcctacaaataattgaggcaaaagtgcctgggggctggattaactgggcgtattttctcaattcagcacttgtacttgagggtgttgacagagtgcagaggagaattgtaatcctattgacaagactgctgtgagaaaaaactaataaaaatgatgtgaagacaaacacccaagtcctgtttcccagggtttccaacattagcataaatgaaggtctgttttcaaaaactcagcagaatctttatgccaacaaatatatgagaactgatgtttggtatacacagccttgagggctgtgtgtgtgtgtgtgtgtgttgtgtgtgtgtgtgcatgcatgtgtgaaagtctggcagttctctgtattcagggacatatatgtatgtatgcatcggatggcagggacttggaatcagagcacatgaataatctctttgcaacctaatgatggtgtggcctctgacaagtgacacggaaaatccaggcttccacttacttttcttgctattgaaaataattatttgcctcatggagccatcttgaagttgaggtgaaataacacctgccataatggagttgtctctaagaaaagtaaacactgaaacaggcttctttttcagaacaatgacacttacctggacctagggtccttcttaaccacatttaatcatcataataagtgataaccacaataattgatggccacagtaagtaccataatagtaccaattgctaatatctcctcaatgcctcattgcacactcccagtccccactttggccaggcaccacctgcttctctgccacagtaagattacagtatgctgccaagatcactacaaatccagctgaactaaaatgcagaaataagagggatgaaccctgttccccagtttaagagccagttctggaggtgagaccaattggtagagcaggtaaacaagaagaaatggactgaaactaaaatcacacaaaaccatctgagaaatacctggaagcaccaagccctcagaagatctaccagttcttaaaacatgggcttagatttgcacattgtactaaaaagcatactcattcctttttggtttccttttttcattgtcttaaggtttttgattagtgccaccctgttgaagtcaccatgatttttcctatttcctgaaaagctttcaatatttcaccattaagtgctgagaaatgtaaaagaaaaatctatttacagttccactcgtttagaggataccaaacttgaatgttgtcttttatcacagttcttctttttaccaccacctgcagctctttaaagaccatgaactttgaatggttttagtatgtcaaacacttactgagcctactgagtaatgaatgatggaaattccttaaatcaatggtatacaaatgatggcactgattctatcctctccagggcattagttttcagtgtttgattggtatcccatcaaaacatgtactcctccactctgcaatatctaccaatgaaatcttccgaagtcccctcctctggctgctcaatgaagtccttcacttgtctgtatcccttgcctggcaagttactaaattcctttttcagcttttcctttaaaaaaaaaacaacttcaggagaaactcctctatttctagttgtttaaaatttttattatgaattgaaaactgaattctaccatatttttccctgtacaatttggctcttatatggtttctttttgtgtttatttagtttgctaatattttgtttagaatatgtgcatctttatttattaaagagatgggtgtgcaatctcactttttttgaagaatgtacactctttaagttttctggaaatcttggtatacgagggaaatatttctatattgaatgtctgggactattttccaataatattatgtagtgctggagtttctttgtgggaagaatttggatagtgaattcttttaaaataatggttagatgatttttcaagttgttgatttttcttgaatgatttttaagttttgtccattatctaaaattacaaagtattagcataaggttattcataatatattttaaatgtctatttaatatctgcacaatcaacccccaagagagacaatctgcatttttggtcctgagataaaatcactaactgttaaatttgagctctctcccccatagcaggagtgaaggaagactgaatggacaagtgtggggtggaggttgtgaaggttttcttttgattgcttctattttcttggtgaaatgaaaagcaaggtcatgggctgagagtgagtaggtaccagggagtatcaaggactggaagagaagaatgagttatggaagagttgtctcagagagtaaaaggaggaagtgaccaggaatatgttgtatgatttccaggcagcttgaagtagttgttgaaggcttatggtcataaaatccaaatgacatcagaccctgtggctgtgtgttcctccatgtgtggaatagatagagagctggatgtaactccaattgagattctggcctgtaagggtgaagaagtcagagtttgctggattggaccaattactaataaataaataatgctcatattcttttgttttgttaatacttgctgcctttaattttatattatctaataaaaagttcctttattttcaattttgctttatattttaatatatttggccatcctttaatttttaatcattttgtgccatttggctttagaaaacatatctcttgaaaacaggacaaaacaggtggtgatgcactctttcttattcttgcaaattgcattgtgttcttccttgctgtttttatttcctttttatgctatcttaaattctcatgtcttctcccattggtttgaaaattataattttaatatttacactctgatggtttcaaaacatacttgatactttgtctttaactacattagaaatgaaaatagacagcacaatattttccaaaggaatgcgaaaatttattacttttgttctcactgtcctctttctctctaaaagtattatttagttgtattaaatttttactaatacggaatttttgaataaggtgtttactattacatttttatattgtaatagttactttattcaccaatcagggaaatagaatgtttttaatttatttcacaattcattacttactatctttgaaataatacgtttctcctgtctttgaatagtatcctggtcacataatgaaaaacttcccaaacttagtatgcacacaactcactgggattttgtaaaaaggcagatgatgactcattaggtctgggtgggcctgagattacacatttttaacaagctccaagatggtacagatgagcagattgtctcatttgccgatcactttgtatagcaggaagatagagtgtttccttgaaaaccttctcctaagaacagtgcacagctagtatagtttctgagttcttgcagaaactgagactattccaagactactgtatcattacccttgtgcaatgacagtagtctgcctagctgattgtcttctggtgtcacagcatttttttttctcatagattttcttgttgtaatttttcagaaagattgctttttagaagatggaaatggatcatatgagtaagaacgtgcattcagtgagacatactattttgagtcatattttgttgactttaaattgtgtaaactttttgcattaatagtgtttaatgtgtaaagtacatcccacttgatgatatgtttctaaagttcatttgtttattttaatccaacaaacatggaaaaagagttctgtgaatagcatccttccaaacatacgtgatacagcactgattaaaatcagcaaaattccaacccccaaggagcttaaaagaaaaaaatatcctggaattaagcagtaatagtggagatcaagaggtctgaatgcattcaaataccttttaaaattaaaaattgcaagaataatttgtaagtatcttagtctttggtcttttatcaatttagcttgtctgcttattactgaaaattatgattgactttattaatttatatgatctctttatataatgtggaaaataactgttatatttaaatattgtgtttattttttaaaattaagtttgattttttatttaaccaaagtttttaaatatttaaatggtagaatcttttgcttcatgtgtttgtattttcttctctgtttgggaaatcatattgtacatataattttgggtcacaaactatttggctgactttaaattgtgtaaactttctgcattaatattttgaaacatgtagtgtttgatgtataaagtatcaatttttatcctttgaatgccattacattgtctttgtttctttatatagtcatatttattatgtgctctttaaaccagttttcctaatgtcagattaaaaaacaaaaaaagaaacttttgttttaagttcaggggtgcatgtgcacatttgttatatagttaaaatcatgtcacggggtttgatgtgtagattattttgtcacccaggtactaagcgtaacacccaatagtcatttttactgcttctctccctcctctcaccctctggtaagccccagtatctgttgtttccttttgtgtccttgtgttctcatcatttagctcccatttatatgtgagaagacatggaatttggttttctgttcccgcattaatttgctaaggataatggcctccagctccatccatgttctcgcaaagaacatgatcttgttctgtttcattccatacatagtatttcatggtgtatatccagattttctttatccaatatgccattgtctttgaaagtctctaagaacttgttgggtgcatatgtattttggatagttaggtcttattgttaaactgcaccctttaccattattaaatgcccttctttgtcttttttgatctttgttggtttaaaatttcttttgtctgcaattaggattgtaccctctgcttttttatgttttccattttcttggtagatttttctccatccctttattttgcagaagttctctgcatttcctgaatttgaacgttagcttccctaactaggttggggaagctatcatggatgatatcctaaaatatgttttccaggttgcttccattctccccatctctttcagggacaccagtgaatcacagattcagtctctttacataatcccatatttcttgtaggttttgttcattttgtttcatttttttttttttattcttgtctgactgtcttatttcagaaagccagtcttcaggctctgagattcttttctcagcttggtctattctactcttaatagttgaaactgcattatgaaattcttgcagagtgtttctctgctctatcaggtcagctatattctgttctatactggctattttgtctgtcagctactgtatcattttactgtgattcttagcttcctccaatttggtttctctgttctcctgactctggatgatctttgtgcctattcatgttctgaattctatttctgtcatttcagccatctcaacactgttgagaaccattgttgaagaactagtgcagtcatttggaagaaagaacatgctctggccttttgaattttcagagttcttgtacttgtcctttctcatctttgtggtctcatgttccttcagtctttgaagttactctcctttggatgggtatttttcccttttattttatttgatgactttgggggtttggttgtggtataaggtgggttcagttgactggcattgtgaatggaagattttagggggccttggatcagcccagaactcctgaactgcatgctctaactctggggtactgttattgccctggcttttatctctggcctctagagattagaagcctgctgcactggaggggcagttgctcttggactactggtcataacacttcgaagggcggggccagccaaagtacttcatagggtggtggcagtggaacctgtccttgttggcatgtgccagcagcagcagtggcaatgagacagggtgcacacttgtcagctgggcagggtgctagtgggtgctggggtgccagtttctgtgcaggcgttcacagcagcagtggtggtggtatgacttgggtggatggcagccctcaccggtgactgtgtgttcatgctggtggtggtattagcatgggggcagggggactggtggactcaggactgtatgtctttgagtgttcaggctggtggtcgtggctgctaagggctggggtggtctgcctttttccgctgtctagtttgtggctggcagcagtgtcagtgcagggatgtggtgctggtgggggcaggtctggcaggctccatgcccatcaacactaccacatcactggcggtgccgcttgggggtgagggtttagggtgcactcacacctgcagcagtggcactgcagggtgcacatgcacacgtgtactgctgtggaaggaaaggttaggtctgccggtgtacacatgctcctgcagagcaacgttgggggtggctgtggtcaactgcctgcaggcgaagcagcatgggggaggctgtagtgctagggagggtgtgagtgggctgttgaatgtccataagggctgctctgctggagcactctgccatcaggtggtcctctagcataggagctatgatgtgggcccccaggaggtaactggcctacaccaaaccctctgggctctgcacctgctggaggtatgcccctaccacttctctaatcagctttcaagtgtctgtggtggttgggagtttcctcctgccagaattaccgaggcctatggtgagagcgagttgctccttgcctgttcaactcacctccactgcaggagtcctggggggccaggaatgagtcctggtgcgcagttgtcccattcagggttcccaacttccttcaccttcagcctgtgttctgtgtcttccctctatctgttgtcaattccttccttctgaatatctgctaggagtgcgccagtctttcagatgtcccggtcccttagtgtgagatgttcttcctggctacgtctagttggccatcttgcaagtattttcatagtaggcaattatcagacttttaattatttctttatatcttttaggcaattggttaggcttaggcaagttttcctaacaatcagctggatgtgctatacccataagattaattcaaccagtgatcatatatgcatattgtgaacacataaacatcacactctattaatttgtaaacgtttttgaaaagaaacacttattaattatataatgtattattaggcaattatttatccagtttttaaataaacagagtttctacaatctgtatttttcaacatattaatttaatgtaggaattaattgcctgtgtttcaaattataagttttatcttaataaatgcttacagaattaacaagtctacactgttagagtgatcctagacttgttagtgaatcactaggagaggatcaagatgcccagacactgaagagacagtgtagcaagaatgcatcacacaggaatgggagagaatcagaaatgagaaggggaagatgccatagaatccatgacactgagcacttagtatgtccctagtaagacttactatgtatgaaggaaggtaacactcagcaactagcatcgtgggaaagagcctaagacagaacagatggagtaaaattgtaaacacttcagcacgcaataccagagacaggagttaaacatattgcactaatattctaaatgctgtcacaatggaacgatttaactcagttcagtgtttgggacatcactatcaccatagctaattacaggggaatccacatgaagcaataattgcttagaacatattcaagggccaggactgctttcatctgtgaattttgactttaaatcactgcctgtaaataatcacagccaaatatttgttgatttctcaaaattttgccattggattattaaaattttgccattttaataatgtcacaatattataacatagtttactgactgtatatatgcctcaatatataattgaattagttatgctgtttgttttaaatgttaataataatctttcattagatcactttcactcctccacatgacttccagaaacaatttgctaggttataaaagtattttcctttggattttttactaatatttcatgaagatatataggttggctttgaaacattggtgtttgatcacctcattcaagaaaatgccgtttcttcagatatccaagtcacttttatctccacttgcaaacttttatagtcttgttttgtaggttatgcatccttctcacagtatatcctgaagaattttaaatgttagttgctatagtgaaggagatcttatatattctatgcagccagaaggggctcatcatgggggtattaatttttatatatttataatatgtgcactatttattggacttttctaataatatttggcattgattggagcctttagtgcctccttgttcaataccatgggtatgtctgtattgatatagaattgagtctcagcagactagaagactctgaaatatctgtcagaaactaaaatcttgtgggaatgcctgaagtgaatctcacctttagaagggcaacaaagtgagaaactggttaattttggactctataatggatactattagattttactcttgaaacatctgggtggcagaggtcaattaagcatggttgttgaggaactggaaagtttttgttgtagtcttttgctgtaccatctatttacagaaagtattatttttaaacttttgcaaatataattttatgtttttccctaatttatattgctgccaaatgggagagcacaggtctaaattattgtacctgccacacctacatgaggtggaaaataccatgaaagtatctttgtgcagaaagggaggattcatggtgctttcatctgtggacctccagtggaaggaggacaatccagacctaatttagagcacggtgggaaacataccttttcattttatatctttaaaaatctatggaggggaagtaactgattcacacaatttagacattggtttatcctgtgtacttgggctgctcaaacagggcatataattcctaattccaagggaggataataaggtcttcttttcttgcaacccaaagaggttgagcattcatatatattttttcaaagtcaaaaaaagtacctatctgggaaaacccaaacaagctgtgagattgctattagttaaatgattatctaaagcatagatatatacatggaagcacatggagttgcattagccaactcttgtttggtatatattaattctacttctcttattagcgtaatagtgggacttcaagtaggtagtccttgattatgctatacattcattacgatctaggacagaggataaatttagccctcagatacattggtttttgccttcatgtttcattttttaacatttacattgacattaaagtatattgtttatgtgtctaagtttataccaccatttaaatattagtaatcaacatttttagtttttcttagaaacagaaaggctgctctgcccatgactggaattcacatccacaggggccccctttagatgagcatgtgcccctggcatttgccatgaattgtcaaacaatgttttggtcacatttatatctgcctcctccactaattttagcttcatgtctggttcctgaaggcagatagaactctcatttgcatttctgtaattcatttttatagactattgctgtatttcatcagaggtaacataaagattaaatagagtccttccctgtcagttctacagctgcctgagaaagttttgtctttaatgtgaaacaaattcttttctatcttctgttttcctttcctcttagcaaagatccaagtaataaggaagtttcaggaatcatggatatgttaatttcgtctttatatatgtatgtttcctacacgttatcgggaagggaacagttagatacgtcccttgtcaaagaataaacattatcttctgggttaaatttgattcagaaagattatgattataagtatttgaatagcattatgcaatatataaaagatgatcaattatagtacatctttcttatttttggaaataacttgaactatgtactatgctgtcaagctcaaagggtatcagaagagtcaaacagacaggtgaatatgtctaggcatatgttttgggtggacagggatgcacttccagccagcttctctgatgctgattcctggttttctccactacaccatgacttcatgtttctatcaccaccatgaagtgcttctctagtccttgaaaggaaatgtaaaaattgatattttcactgtctccccaggtttatggtttaaccactatgcagcttagggagagctagatcctgtagagaggagaaaaaggttaaatatctttaaagcaggtgactggctccaaggttcttaggttaccataaatgagaaaatgagttcttaagcaaagagaaggagcttgctttggaagaaatcatttcttaagaagccttgatgtgcagaagggacttactagctattttgtaccaattactatgtattcacaacctttcatttgtgatcttgttgaataatttataaagtgtcatgtcatcatcagaaagccatatgaggtagaaaacaatcctaagtatttacagatgagaaaactgaagttttgtgtggttaacatactcatagttaatactctgagtaagtggctgagtgagggttttagcccaggactctcgaggttgagtctattatagctgtcaggggtgctagaaggcagctattttcttgcaactgttctgtttcccaagtttcttctttattaatccattgcactccgatctaccttcatgagacttctctgattaaagacacctacattgcaagatcagaatctgtcaggcggccacagattgattttcttactaccagagcagaaaaacacattttctatttcccatatagatttttcagtgcagctgtgcaggtaataaactattggcacattcagattatgggtgatgcacaaaatctagatgtgttgtatatgatcttccaaaaatgcaaattaaaatggtatttgcttcatccttcagctctggtgtttcatcacccaatgtcactacaacagtctgacagaaactgcaggaacaggcagaatagaaaatgttagatttggaaattctggtaaactttatttaatatgcaccctatgcagagagacatggggaagatatgcctatgtttggagcaatatctttatcaaattagcaggacaaaatgaggctaaaggcatgacatatcttattgtccacagccagtcttgtagctcagagttctctggcactgggcttaaaggaaagaccacaactggctatttaagagacaatatttacaagaaggtgtccagtggaatgtcagtgcccatggaggtaacatctttccctctcttcatgtttctgtgttggtccttagtttaggatttttatcaaacatttctacattattgggaagttctggtggactttcgccaccatttttaccttctcaggaaagtgtttagaaggaagggtctgtcatttcttctagcccctcacttttcctccacaagggagaaggggtggttatacattggagggggctggagtaaaagtcccttcatatgtgtgatctcctctcccacttactttctctccaatatgcctcactacaggaagcatgcctccggaaaacacttctctggtttcctctagtctgttggataaaaactaagtcagtcatggtcctcagggaagctggttggatgattatctgctgttcatatcctagtagtgtctcactagccttaaatactggtcccatgacccactttagggaagaaaaaggaagcatttgctttggcctgatactaaatctcattttccagatcgtaattatcattgacagcactggcatttttattcctgtctgactgtggtttctgtctttgattctgaacataaagagagataaagtatttcaagtgtagtgacccattgtcttgctgacattagcttagaaaaagcagaacacagcagaaggagggcaagccttgcaagaggtcaccacagtctagaaacttggtttgccagggaaactagagctcatcaggaccttggaaatggcattcaacaaacaaatcataaggcactacagcttagcagtgtgaatatatcatcaggcagtgagaggaaaaatgttcaagtatcccactctctgggacccacgtttatctcttgtagggatatctaaatggcattcttactggaaacaaagatggccttgactgaggggaaagacagtgcactggatgatcctgttggcccacattagtaaagttggcaatccaccacagaatcaccattgggataaagtatcgccatgtgacagcacatggagtctccagcactggagacaaactgaaaggatcttggtggtgtggtagggggaggcctttatctaaagtccacaccagtgacttttctcctactactttattatctctctagacacaggggctaagggtatgggctctagggaaagacaagatctgtgtttgaatcctagatgtgttatttactagctgtatgagccttggacacaaaccccatgagcctcagtttgctcgtctgaaaaatggagatgacaattacacctacctaattggtgtggtgtgaaagtcaaattagtgctatgcatgtaaagtacagtgtctggcttgtaataaataagcagtaattataaactactggacctcaagtgaaaaagcctttggcagtagccctagtaagagctttagtgtagatgttgtttgaacaaaggttctgcgaggcaaatgtgcgaagcaaactaaaccttcctttgcaagacaggaataatagttctcagaaatgagaggcaaatgttctgtctttaaatagaaattatgactgttttgtaactgatgggctctatgagtgtgtcaagagcacatgctttgtggttagatagacaaagatacgcattccagatctctggcttagtaacccaaagctttgcttctttaggattagggaaaataagcataactatttcagaagattcctttggatagtaaaaataaggtgcttagctcaattgcccaataaatagttggtccttactgacaagtcaataccatgcctgcagcagctatcacaggtggcatagccatggcctagtaaatcccagatttatctctcagtcatctttctgtccttccattttcccattctctcatccttcatttcttcactcatttcatccttctatccttccttcgtccagtcttcccaatctaccatcctttcattcttctatctgttcatccatttatccttcaatcctcccttcttcacattccctttccacatatccttccctccatcttccatccttccaacctttcatctgtttattcattcatgcttccatccttctactcttgcatgccgacctcctcaggatttttgactagattcacacagaggcttcacactaagattctggaggcacacgtgtcttcaaggtgacttaggggacactggaaaggctggctatctataaagagtaaggaaggaacgctagccatgacagctcatcttaaatcagagaagcttctgatttgaagaaggaaagaattctttgaaaccttaggactacattatccccaagcgtccttggagctgtgttcagtctgtgcatgctgggatggtgcaatagtcactgtgtggactgacgtgctgttgtccttgccatccctgctgtaaatatttaattaatcgatttaggatctggaatcttattcaggaggctgaaatgaattcttctagacctaataaagttcttaagcaaaattatctccttgctatttggaataattcaaggtacaacaagacaattagtagcatgaaataaaatggttatttactccattgaaaggttggttaactcaatgtcaagtctgttgtgctgtgtgtatagctgtaatttcccatggtaaacttatgtgtttaattatagggtcaccaatcatgagaatgccagttaattgcaaaatcttaaagtatgtattaaacttacatgctatttctaattgagctttgatttatttaacatgatatgattgtagttacttttatcagccaccatattattattacttttgttttttatcgttttcaaaatactttctattatacaagtatccctggctctcagaatgatgttttgcagaaaaaatctctgtcagaagagaaaactgaaactcagggacttatgtaaggttttgtggccaacacatggcaaagtccaggctggaacctggtagttaaaagggttgagtattagccacacacacagggaaaggagagcaagtggcctgaggaaaggagacactcaggacgtccactgaaggtcaacatagagcaaagctttgctatggctccagatatgtcaccttcaagacaccccagctagtctctatgtctcagagcactaatctactatgatggttcatttaagatgtcagcttgatggggccacgggatcccagatatttggaaatattctttctgagtgcttctgttagggtgtttctggatgagattaatatttgaatcagtagactgagtaaagcagatagccttccctaatgtggataggtctcattctgtccattgaaggtctgagtagaataaaacactaagagagaattccttctgtccacctaactgtcttcaagctaggtcactggtctcctgcctgcagacttggactggatagaactccatcagctctcttggtcctcaggtctttggactcagatgaaaactacaccactggttttcctgggtctccagtttgctgactacagatgttggacttctccacctctataactataccagctgatttcttatagtaaatcaatttctctgtctgtttctacatgtctctctctctctctctctctttccttctctctttctcttcacacacacacacccacccccccaccccccgacacacacacaaacacacacacatgtcctttggtatctgcagggtgttgattccaaaacccccatggatattaaaatccacacatgctcaagtccgttatataaaatggtgtcatatttgcatataacctgtgcgtatcctcccatatgctttaaatcatttctagattacttataatacctaatacaatgcaaatgctatataaataattgttatactatagttttaataaataatgacaagacaaaaaggctatacatgtccagtgcagacacaactatctgtttttttccttccaaatattttctatttgcagttggcagaatccacagatgcacagctcacagatacagagaattcacagatacatacacccttggttctgtttctttggagaacccagactaacacatttactatgtattaacccagactaacacatttactatggtactttctactataatccttttgtagtttcaacacaatagttgtttggccttaaagcatactttataacagtaacaattaatatttgtatggatttttaatcttctattatgtgtattttcacatctaatccttttaaaagcctgcataacaaggcatttattaccatctcaatttactgatgaggaactccaggctaaaagaaatgaagtaagggctgggtgcagtggctcatgcctgtaatcctggcactttgggaggcagaagcgggtggatcagttgaggtcaggtgttcaagaccagcatggccaacattgtaaaaccatgtctctaccacaaatacaaaaattagctgggcatggtggccatgtgcctgtagtcccagttattctactcgggaggctgaggaaggagaatttcttgaacctggaaggcagaggttgcagtgagccgagatcgcgccactgcactcaagcctgggcaacagagccagcttccgtctcaaataaaaaataagaaataaaaataaaattaaaaaaaaaagaaagaaagaaaagaaatgaaatggggtaaggtgccataggtcacatctagataaggttacaggtggcgtgtggctgagcagggctcagcctgtgcttacccactctggagctgcctctttagagcagggccctctgcatttgacagtgaaggcaaatgtgctcagcaagatggcattgaagcttaagccctcgatcttttctctatcaaattctgcgatgtttctggttttaaaagaccattccaaatttaataatttgaaatgtgctattaaagaacagtcttttcagttgtgttgctttagaatggactgcattttaaaatgtgcctttttattcaactgctttctacttattgctcaccatttattcatgatatgttggcaaagtactgaatcttagtaatttatattttcagacagaggctggagattgcctttaacaaattaaacattatactaatgcatgcaggcagccactgtttgaatgaattgggagaacaagaatacctatttattattattttctttctagattcctgtatcagagtttaaattgtttcagagcaagaaatcacgaagtacattacttatgtatcctttttcctttttgtttacatgcataaaatttagatgggaacacacacacacacacacacacacacacacacacacccttcagggaactatgctaaaataagactcagaaaccaagagaaaattactttactgctgcagcctcctgcctgctctccctctctcccctacagagagaaacactatcatacattttatcttaattatccccattttctttgctctctttcccccacaggaaatatatgcatctctaagcagtctatagtttggttttaggaggtttggggctttgtctaaagaaaccatactgtgtgcactattttgtaacttcgttttttatccaacctgttttgaagattcttctccacatgtgtcatatacacaatttgccctagaaatgaacattttaaaaattgattagtaggggaatcatccacttccaactaaatgggcaatcaatattgcttggaaaattacctaaggagataaaagctccaattatccctagttgaacaaaagcctttgacagagcactgaggttatgggcaatcttggcttcaaccttcacttttgtgagttgaaatcctctgtgtaatggcttcagccttttgaagtcccactccacctgtctatgctgtacatgacagttattcctctccacactacctaaatgaaaggtagacacttgtgccagacaaacagaatcaataagatgtgtatgtgtacacacacacacacacacacacacacacacacacagagtcaggagtcagagagatttattataaagaattggcttatgtgattacagaggctggcaagtccaaatccgcagtgtggttggcaggctggagacccaggggagctgcttgtgcagatgaagtcccaaggccatctgctgaagattccctctggttcaagggatcagtctttagttctattcatgccttcaactgattggaggagacccactcacattatggagggcaacctacttactcaatgtctaccaatttaattgtgaattttatcccaaacaccctccaaattgatgcataaaattaaccatcacaatgctgaagaccagaaattcagagttttgaaatgtctacctgaaattatttctgctctataaatgtagatcacatttgtgacagcttctctgatgagtcttctatgtctttatgttctcttattgatattttgtgaactatcttaatgcctgacgtgtaccacattgttactgttattactttatcctttccttcaggtagattaacttcaggtcaggtaatgagtctcattcactttcccatctctgggacctcatactgtgcatagcacagaacaagtacgcagtaagtacttgctgaatgcaaaccaacacagtcttgataaatcacactcatttcaatattaaggtataataataataaatagaagtaagcctctttaatagaacattgtgaaagaaaaggctattttctttgcttttgctttctggtattaagatcgtgactctaagtgtctggaatgatccagccattcagaatatatctatgaataacagcactagactggaaggttctctaaagtacatctttataaaaagggtaaaaggattttcactcttgactgaaatcaaatagaactctatgtgctttgcttaccagttaacttaggcagagctccagaccactacacatgctccaccgtgacattcttgttctagccccgacttcttatgggattagtaataaccacagtgacaaaaaagatgaaacttatcctcatctggtcctttttttttctggaatctgctcattcaccctcaactagaacttaattcatggctctgggatgtctacttctggttaacaatccttacaacgatttgcagaaagtttgcagagtgtgcttgaccattttaagcagcatacaattggtaattgttatttctggaggctaaatagtcccctccactgtagcttctgccattccaatcatcttccacagaagccattctgagcatgtcggggcttctaccagttcactctggaagtggatttggtctcattactctctgtctaattttagcactctatgtttgcagcagtctctgattcatatacatctttctgcattagccatgaatagcacaggagcatttgaaaacatgctgggtgtggagaaccaactcttcaatgtgtgaacatgcacagttctttgtgtgatttaatttaatcttgtgagatagggtaacttatccacattgtgcagatgaggaaaataatctaagaatggctcacattataaaattcataaatggttctgccaaaattaaaacccagatccatgtctagaggacatgctttccccttttcaactctcctccagatatatgagcaccagaagctctggtgtgtctgctccttatctggaccctgaaggcaggtgaggaagatggtgattaagagactacttagaatggttttcctgacgcttcgccttccttgtcattctgacctccaccactgtctttaccaagcacacagtgaaccacctttagccatggataaggacccagtgctaagggctgaactgggaagacctctgtcatagtgcctcccgtataccccagaaatcatgactccatgcaatgactcccaatgggaaacctctaaacactcagcttgaatgcaggccaggccagaagttctggggactacccagctccacacctcagaaacagccctcagccaaagggctgaccacatatctctctgttagattggtctggttccaatcaagtcacaaaagcacactgtggaacaatggaaattcactcattcaaatctgaccaaagagaaattgcaagagataaggacactctataacatactgggaaagcagaagagtaaggaggatgaacaaatttggagatagccccttccccaaagcaaggattctaacctcactagagaaggtacagttgcaccccagtgataagcaaacctctcaggtttcctcagccagagttgatccacagtcagtgagcaagcaggaagcagcatcctagggcacaggccaggtatgtggtggtgtgcagagggcatggggtgccctggtgggcaggaggcctgaggttgtgtgttcatgttgagggagccacaggaaggtgatcagctggctggactggagctataaggtcacaaatgcaccatgcattctgcacatgtggccagagcagagccccaccaatgtcctcacacctatgcttctgagtggccatgcagcactgccaacaagaagggagctccctgatcctgcagtgtcccttgcagaaccctctactgagaaatctcaggatctgtcatgctcaatataaaggaggaaggcatacaggaatttcatctattattgcagtgtgagtattgaagggtgaattttgacttgagaggatgacccatgggttagagtgactctgaggtatactttgcaatgcctctcagagtctaccagtatgttaaaacccagttgtccatagatcaaattcgcatctttcatgggcttccttctatttatttttcacctccacatttcgtgacgtttgtttcctgggacagcttctatgcacattcttatctcttcatgtggttctagaaaaacacaaccttagcagaaaaatcaagcagagagttcaagaatgagtgatatatcatgagtttttactatgatgagtgtatgaggtcatcctgaacaagtaagaagcaagtaaaagacacacattgggatgaaaaaaatgggattcacataataattgtataacactgaaaaattatatgagctttgagtaggtcacttgcaatatgcagaaagcaactcaaagggctgctgagaggattaaatgaaattatgaatgaagagatgttagaatgcttacaagaaaacctttaccttcaatcaaactttcattggcccaagccaatgtgcatggtttcaaccataaagataaagaatgatattatcagtgtttgggactaaaatgggcaaagtgtcttggcgatcacaagtttagagtcagtacatttggaggaaagttagagaaagctaactcaaacttgagagggagagagagatagagaaagagatcacaaacttgttgacccacaatactgtaaagtccagcagtaatggcttcaggtacacatggatcaagatgcttcggaaggcctttactctaaatttttgcttacttttcaaatggcttcattttaaattcaggttcttccttcatgagagcccaacatctccaggtggatatttgatatattttcttcgtatttagttttaagagatttgattattacgtgaatttcttttggttcattttgtttgagaatgactcaactttttgaatttgtaggtttatgtcttttgccaaatttgggagtttcaactattattcctttgatttattttcagcacagcactaattatccttttcttctaaaactttgatggtatgattgttagacctttatgttattgcctggcagatccctgagactctgctaatttatttttcatctcttttgtttagattagattatttctattgatctgctgtgccttatgctctcctctgtcatctctaatcacctagttagccaattcattgatttattgcattctcttactgtaatttttagttttaacatttttagttatctcttgtatttactatgactttttatgttttgatttgttttaagggtgttcatgattacttgttggagcatttgtgtgaaaggtgctttcaagttcttatcagataattctcacattagtgtcatcctgatgtgagcatgtgtcttactgaagttgacatttaacacattcttgatatgctgtgcaatttaggatttttttggggggggacgttacattatgttacagaactagtttctgttaaaatagtttgttttatcaagcactcaatccatataggctaaggacattttgtagtctatggcttaaatgagaaattagttttcaaagccttgcagtgttattctgctgttcctattgatatgcagcccagtgacaagtctgaaacctggactattccatgctgcagctcagtgtcttaagctttcagtgtgagaaatatagagtgttcaggaaggacttcagatacacacttaaagaaccactttctctggctttctcttcttttctccttttactctacttggctgagaaagtggcactctgctggattttgtctaatatagggcaggggtaatagtaagtatttggccccacatgtctctggctacagtataagtggagaaggtaggtcaccctctgcttatctttgctaaatgcaaggtgacaatagttgagaggtctctgattgttcttagctactgagtcagtggggagaaacagcacttcttgcatggcattcaactggtatatagtaggtataatctacagggttccatcctgtaggtccacactctactagagcttctggcaaaaatgaaggttttgtggggagtttttgttctgtgtattttttggaagttctgagttgtaaattcttctagcatccaggttgggatatacatatagcaaatgggcacaaaacaaccaaacaaacaagcaagcaaaaaacacatgagtaaacaaaaaaaatccatggggaattactgcatttgctcctggaatcctgaggtcttacttcctttctttgtagttcagcattttcccatagttgctacattgattttgtccagagtttctagttgtaattagtgggagatgtaggagagagtgtgcttgttgcatcttagccaaatctagaaatacctagttttacattatatttcaatgacagaaatagaaattatgtatgtgtcaggtatacttgtatccaaccaaactatcattggatagatagttccagttgtcttggatttagaatggtctggagccaattcagtttcacaattaaactgtagatgaattcttccacctgaatgatagatgtgatagattaaccagaaaaaacttgagagatacctgttcgttcacaagctacactttccagacctgtcatctatttctgctgcttttttttgacttagagatagaggaatagatccattgccgtaatataaaatgtactccagttttgctttttctctccttgtggttaaagggaccatagccagtacctttgccaataattagcaccctcaagctgcctgaatttatagaactgtagaatattagagatgaatgcaatcttcacaatcaactttatatttacttcaacctaatgtttctctctggaactgtattttccaacactgtagatacatttcaattacctaatagctacatggggccagtgggtattttattgaacaatattttcatccacatggaaactctactggaaagctatgatctagaaccttctttactgagttgccaggcagtagctgtcttacctgtaattgaatacatctctttcaaactttaatacttctattttagtagtatgaattttaactagatatagcagtccctgctcagagtaaatgcatttggaagatcaaaggctctcaagtcagaatgacctgggttcaaattatgtttagggatagaaaaatacgggatatgtcaatttactctattttaatgaatttcaaatttattatctgtaaaatagagagaacaaagcttcacacataaagttactgtgagaattaaataaaataagtgtgtaaaaacaattaggaaagttacatacctgattgcttctttcctatttttaatcacactgagctccttaaaacaaaaagaaaatcctaaagtgtatgatttttgtgtgtgtgtgccagaatgctgtatttagacatcattgttgcagaagtattatctccctcattctttaattataccattgctatttttggacccaggtgtaggattttatattcattcatgctgaattctgttctactccactaagcctattacttaagcctttgaaggactttccaatccacatatgagcagggattttctctcttcttaagcctcacataataaacacttagatgatagttttctattgctatgtccaaaaggtttatgcacatgttgaacaaaagatatagttgggccctgggtgtcttttaactaaatcctgttgaccccagctcaaagtgtgctctcattactttgtattctcctgtttacacaagtagcaatccgaatccaaacaatatgaagtcttcacagagatatctctttctaataataggcaagggttgtgtaccagtagatttagtgctagtttttacttgttatatggaataatggccccattaaaaatgtccatgtcctaatctctggaacctatgaatatgttcacttacagagtaaaaggaactttgcagatggttattttaaggatactgagatggggagattatcctgggatatctgggtgggcaaagggtctttataaataaaagagaacagcagagagtcagagagaaattctaagatgctgtgctgctttctttgaagatggaagaaagtgccatgagctaaggaatgcaggtagcctctagaagtgggaaaagacaggatagggattatctcccagagtttccaaaaggaacacagccctacggcaacttcattttagtcctgtgaaatagagagtaaatttgtattgtgttaagccatggagtttttgataatttgttacagcagcaaaaggaaacaaataccttatattcagaaaattttcatttcaccacgatctgatctgttgagacagattcctccactgttgttgctagtgctagctgccatctgcagactgtattatgcaacagttctctggcagagactttaaacagattatgtcatttaattttcacaagaaatctataagccaaagtcatttttctaagtttatttatttgttttatttttttcgagatggtgtcttgctctgctgcccaggctggagtgcagtggcacaatcttgggtcattgcaacctccacctccggggttcaagtgattctcctgcctcagcctcccaagtagctgggattaaaggtgtgtgccagcacacctggctaattttttttgcatttttagtagagacaggatttcaccatgttggtcaggctggtctcgaactcctgagctcaagcgatccacccaccttggcctcccaaagtgctgggattacaggcatgaggcaccgtgcccggcctctaagtttaaataaaagaaacctaaggttcagagagtcaggaatatatctagtgcttcagaagcaggagtcctggcaacttctccctggctctctgtatctcagagtttaaagagcggtactggaaagaaccttgaacatttgcttttcctgcattttttttttaacctaagactctaattttgttatctcattataaagtagtgacaatataactgccctatttatgtcacaaagggatgctatgacataaaattggggaaaagtatttagaaatgcttaattttataaaacactttacatatgtattttattttcgttgcaatttaaggaattattagtattattttaatcccatattttcacagaatttccaagaggctaagcttcacaaatgttacatagcaatcataaaaagagcaatatttgtgtatcccaattatgcatattgggaaattagtaccattttggaattaatgaaatactagattgcccaattaaggtgagtgttaaattcatctaacgagcattgtctgtgcattcaattgttccccaatgaacatacgatttcactggaatagttacagttattaaacagaaaatttatagctatctctgagatgtttttgttaaaatcagtatgagagcgtccacctaattgcagctattatccctttctcaacttcatattgcagaacaccacatggctgcaatcaccttataaatggtgatgcttggagcattcattgtacatctcagcagaatttgttttctggtttttgtttttttcttctttccctttttaataaatagaaagaaagcacaaactttttgacctgatgactgaagtccttaagcaactgacaattttctcctaggagaaaattgaaaggtattccctttgtgtttttagctccgtttgagcaaatgctgcagcctggatgtgaatgtggaccaagatgagcaagttgcttgcaggtcagactggcttgtgtgaggatatgttggcactagagtcaacaatgcatcaaaaggagaggcacagatactgtggaggcagctaaaattggtaaaacctaaaattattctgctaatgaaacagtcttagcatggtaatagcaggaactataatagcaataaaaatagaaatgctttattttaaaacaatgggcatttaaaactgtttacttgaaaattggatagagatgtcttcaagaatgagtgatagtagatgaatatatgttttagagtcaaattcatctagattggtattttggatgcaccttggtatcgtcgattcttgacctgtgtttcttcatctgaaaatgattgtcatgccatttgctttaaagtgtagtaatgagatacaggagtgtaaaggatctgcgtggggcacacatgtaaactctgatagctattactactataactgatgttaacatgaaatatgggtggccaaagtggaagttataatgagccattgtctctaattagatcttcaaactggaaataaaactaatatcccgagtattgacttggggcatattgagattattttctattttatgcaaggagaatacatctacttagagcccagagcctgcctaactacagtctctgcagatctttgtggtaagccatgcttagttccaggcaaagctgggaaatagttaaattttgtgttgggctctttacagtctctgtggccctacccttacctccactcttactcatcattcttatcatctatccctattgtcttaggcacctctggctgctgtaacagaatactgcacattgactgggtggcttaaacaataggaatttaattctcacagttctggagattggaagcctaagatcaaggtgctggccaatctggtgtctgctgaggtctctctccttggcttgcagatgacctccttcttgttgtgtcctcacttggcccttctttggtgtatgtgggtaaagaggaaaggaggaagaaagctcgctggcgtttccttttgtaagggcactaatattatcatgcagtctccactgtcctggcttcatctgaacgtaatcactttctgaaggccccacctccaaataccatcacactggggattagggcttcaacctatggatatttgggtaacaaaattcagtccatggcacctattatttttaaaatgaaacaaaacaaataaaacctcacaagtttcctcatgtgctttactactaactctctcaacacatatttgttgatcatcagagccaggcaatgggctggaatctggaggctctggaaggactctggttgatatgtccaacctttgggaggtaagcagtctggcaggataaacaaagataaatcaattaataatagcaaattgagatagtctaataactatagattctagaaatgtcccctagaggctttcgactatggatctgacctactgaaaagattagagccaaagagtgacattttttattgagctctgaaggatgagaaagaggcatgtctagtacatttatggactcctctctaaaatttcaacttatatgttgaacacctactatgtgctaagatccaaagtcagcacagaaaaactgaatggtatatacattctgaccagaatgtttaagtttaaattgcagtatccattcacaattaaatgctaaaagctcttattcatggactgcatataagatacacacccattccatctgctagaatttaagtagctaaatattatctttggaaccatccaaaatcaccagttagctaaggtaccacgcataacatcatctggtcccttatggaaggggttttccccagtagcatctctgatacacatttaaggacattaagaaagataagcatagaaaacttgctctccccttcataagacttcacagaaagaacttttttgttcattcctttgtgttttagcacaaggaagctgctctttttctgtacaaatagttttgattttatagacattgaattccaattatatttccatctttgctttagccaaattggttgttaattttaaataatatttcaagatattatcacatgcatttttgtgtattaactttatgtaacatttggaatgtgtgtgctgataaactgtttcacttatagtaaagactaaggggaaggtgttaccttacacaagaagtgcagagaaagaagatggctctgatgctgattaattcagtggctcaacaaggatccactctttgcatctgtgtgtttcctcctctgaatgttggcttttgttattggagttcatctcatgggtgcaggatggttccatcacaaggagatgtgctcacattgaagggaaggagaggaacctacctagagatttgtcctcatgtctctggccaaactgcatcacatgctttttcattatccaataaccagcaaagaggaatgagattagcaacattgctctagatttaccagtattccccactctggaactggaggtctgctcccttcacacatgacagtggaggaagcaaatgaaacttagagtccagctagcaaagaaggttgaattgctgataagtacgtatcaaatttgtattatgcttacctgtgttttatatggatttttgtacccttatgtctttctttgatgcaatgctctcaactagtcattctattctatcctatgtgaatgtcccaatcatttattttaatgtaaagtggatgcataatcaaacaacaaaaaatagatattaaaacagtccatatactcatgtgataagccctacatttggtattaaagctatagatgtaaaaaaataaaaagaacaaaaagattagggctcaaggagataaaaaaatcaagaggcttttcttacgggcttgatacagaacgcagaggtgaggggagtgtactgccactctgagtctgacaggagaccctgtaggtagtgtttcttgcaactatggaggacattaacttgaaaaaagtattcacgagcggcaccacgagtttagaaacactattaggtagttaggtagttacggcaaatgtcagagtgcttgtcatgagtttaggttcaagcaagctgtgtttgtggtgtcctgttgaagaaatccaagaggcactcatgtgcatctatgaaagcatttcgaagttcagaaaaaaatgctttcataacgattatctcatttgttctttccaatcctgctaagctctacacattatatccataaagaaactgatgctctgaatggctgtgtgctttgttccacatcacactgctaacaagagtccaagaccttttagacatgatatcatttattgagtccaaagcctcagactaaaattttaaaattctacatccacaagacttcagttggataagaagatgctttggggtggagtaggtggaactgaactgagttctctgtttcttaatggatcatttgatgaagaagcctcacagcactttgttcatgtaatttacctgacttttgatctgtccatttacttgttcattcattcatttgttcactcatccaataagcattaaatgaacacaactatgctaggtactgtactgggtgtgttcagatacaaactacacaactcagaacagaagacatacatgagaaaaaagtatgtgttttgctgaggtgctgtttcaagggtgtctggaatttaggtccaattgttactagtctttttttgttccttagattctcagtatccacccccatcccaagtttgctacatatgatagaagatgacaaggcaaaagtattttgtcttgcattagaagcacattgcaagaaggagaatggaaggagaagatattcaacctttattttctagctctatgtgctagacagtcatttatatgttgccatataatcctcacaatatttgtgtgagtggacattattctactgcttggttgacttgataattggtactcagagaggtttagtaccttgcccaagtttgtattcatttgaagtaaatatatcagtatatattttataataaatataaaatataaaaagctaaagaacgtttttgttgataagtctgttggcttttcttaaacaaaacagagttaactcagaagatttataaactgagattaaaagtgactggggagattctaaaaaaaacaaaagaaaatattctaaagcgtaaaggaagcatttaagtggatctctagacagaaacacatgctgtttctcttgtgtcaccggaggagatcatggtgaagaaggaaattggaacaacagctgaaaatgttgagggtgaggatagtaaagctgtgggggacatgaaataaagttgcctggaatgcacttgcttcaaaggtctctgccacctggtctcttatgtatgcattctcctgactgatttccccgtcggtgagccagaacgtcaggcaatttgacaaaatgagagccttcaagtctttggtatcagattgaactttcttaaatgttataatagaaaaactattaggtgggtaggtagttacagccaatgttgcagagggcttgtccagtttcactaaaggtccaaaaaattggtaagttactagcagaatggctatttaggagggagaggtatagagaactccacagttaattcagtgcctgtttcagggcctttctgcttaactagaaactgaactcccaccctccccatctcccactttgcagagaagactgaaatcttgtggcttatccttcttcagttttattccttgccaacaaaaaaatggtgcaacaatttaaatccagcactaatcagtcaggtaccataacttgaagtgggtcaaacagtcccctggatgctattgtgcagaatgatcacttcctaccaccatcccaaactccaaaccctgtggcttgtcccttgcttgtttctgctcaccggataacttggactgggacattcttgcttggtgctgttggggacatttggcttacctgagtagataagtaggtgcatgcttcagccaatgcaacatatttcagtatcctgtccacactcatagttttgttcatatgagccatcattgctttacttctgtaatgaagggatcttgacagaaattaaaaaaaatacttatgttaaagtctaaccttactagaatgttattgaatatattttaagggatatttaacacatggtaagtcagaaaccatgtaaaaatgagccatattataagaggttctaatacatgtctcatcaatcttaaaaagaaaatggtcacaccaattaaaaacaaaatagacatccatcctctttctcctgtgacagaatttaggttcttttcctcagcctataaaacatccagggcttctccattcaagaaatgctatacattttccagctaccttactgtttcttatgctctcacttaccaaaattagttaaaaagtcgtccatatttctggtttcctatcctcatcacacattcaccttcatttcttagtgatcagcctgctgtctactgaaactatacacaagagtcaccgggatcactctggtttttcatttaatgggctgcttctcaactttctctctctgtacctctggcaggaaagatgcttttcctgaaacatattttctagggagtggttaaagctttttattttgagtctgggttgggaaatttggctccactgctttctaaaactgtgagcttaggtaggttattatgaatttgtaaacctcagtttcccttctgtatacaaagcgttactaattcctacttcaaaatgttcgtgagaagattacagaaggtaaggcatgtaaagcatttagtgagatcctggctcagagtaaacattccatgaatgttagcttttgcagccagcttccttttgtttccctttgattgctgtctttaggttcttcgtctaccactctatttttttttattatactttaagttctagggtacatgtgcgcaacgtgcaggtttgttacatatgtatacctgtgccatgttgctgtgctgtacccgttaactcgtcatttacattaggtatatctcctaatgctatccctctccctgaccccaccccacgacaggcctgggtgtgtcatgttccccaccctgtgtccaagtgttctcattgttcaattcccacctatgagtgagaacatgtggtgtttggttttctgtccttgtgatagtttgctcagaataactccatcgcattagttctcctctccctgggggcttctaagtaaatattctataaaagttacttcttcagctcacttttctctgtgtccacatgttttcctttgatgacataattattcccattgccactgtcaatgcatctatactcttaactcccaaatcctcatctctattttaagaatgagcctcctgcatccaattcttcacttaccgtcacattgaaatgtctgtaggactgttcagattcatcacaagaaaatcttacctcacctctcactttctaaactgctctgcgctcccagcatcatccccccagaagcccagaacacacccagcagcagcttcacaccccgccacccccatttcccaagggaatcagccactaagtctcttctcggcttcctcacctcaacactttttccatatccttacttttttttttgagattgagtcttgctctgtcacccaggctgaagtgcaatggcacgatctcggctcaattcaacctccgcctcctgtattcaagcgattctcttgtctcaacctccagagtagttgggattacaggaacccaccatcatgcccagctaatttttgtagagacagggtttcaccgtgttggccaggctggtcttgaactcctgacctcaggtgatcagcccgcctcggcctcccaaagtgctggaattaccaggcgtgagccaccgtgcccggccccgtatccttactttttcctacatcatcattttctatctcagtatctcatcatttcttgccttatctctagtaataatgttgaaagtatttctcctgctttagcctctgcctctccttcacattttcacatgaactgcctttcacgttgtagttttcatcatcttgctcctctgtgtggtaactggggaaacctcccctaggctacaaataagggccagattccaatatccaattagttggtataaattgaatttcccagcttctaatttaaaaatgttctccctgccactgtccctgggctttgactaccacagtctagtctccatgtcctgaaaagtttcccacctccacctcttctgccctaatgcatattccccccattcaggtctctttctctgaaatgctctttctccagcctcatcctatctctgtcctcagagatccttcaagtcctacaaaaattcttgctcttccaagaagttgtccagaaagaaaatagtgtagccctttatctgctccctggacacctggttttgtcatgccattacaatggcttcaccctcgttatcaatgtgcatgtatgtctgtgccattcattccttcaagtcagagaccacatcattttgaatttctatctttcctcagtggcatgaatatattaaaaatgcaatggatacttattttattgaattattgactgtttagaaattacaaaaccaaaccaacatatcacattagtgttgtgaatatagaattaattaattaattatttttgagacggagtcttgctctgtcgcccaggctggagtgcagtggcgtgatctcagctcactgcaagctccgcctcctcggttcacgccattctcctgcctcagcctccggagtagctgggaactacaggcgcccgccaccacgcccgactaattttttgtatttttagtagagacggggtttcaccgtgttagccaggttggtctagatcacctgacttcgtgatccgcctgcctcggcctcccaaagtgctgaaattacaggcgtgagccacagcgcccagcctattaatttattttttaaatcatgattgagaacagatcatgtgacaaatgttagacattcaaagaaaaatgtaatttttctctttgtgctggatagtatcccagtctttagacaagtggttctcaaactttgtcatgccttagaaccacatgagagcttgtcaaaaactccagagtttccgagttggtggatcatggctgatactagagaatttacgtctctacaagttcccaggaggtgccaatgctgctagtccagagatcacactttgaggaccatggtcctagataatgagtccagaattgacttcactactcttggttcaggtggagtcacttcattgtctgaatctcacttttctcttatataaaaggtattcactgggcaaaataataacttgcccagctctagtattctacattgatttgtgtaatgcatttttaatgaataaataaaatctagagattctggaacttttgacatttctttcaatactggtataagaatgggacatgagttattttcatatcttggattgtagattgatttcccctagatatattttaggaaatctagattatgtttcaaggccaaagtacagtcatctccaccttgctttgaaatagaatcttctgttaacagacatgggtgacttagttaagtggtagttgtttcgaaagaattctaatatggataaaatctgtcttatttttgcatttgtctaggctgaatctggaacaaggaattcacaggctatgcgctctggaccataatttgaacagcatcacctagaaagtaattattagaaatatttgcggaagagaaccagggaacagatagaatttatggtaaattgtctgataagtgtttaatgttgtattttgggtattatgagcctaatttttgtccaggaggcatgagatctggctaaatggagccttattatcttcactaggtaacccagacctttaccttagaagcaaagcagagcaggaaatagcaggtgttttgtggctgcacttcacttctgccatcatgttcatgcgttgctttcatctgagaatttggccaaaaatgaaaagaaagcaaagcaaaagatatacagcccacaggccaatctgtttagattcccagaatttggcagggcctcccagactgagtctttcattgaggagatgatcgatggcaataaaattcacacagtgaagacacagcttcatgctataaagagtcaagctggaatagagaagtcttattagattctcagtctctctttctttcatcagtcttaaagatacaactaattgctatagaaagcctagtcaacatatggggttgctgtctatgtgtcaatgttctttactcttagaacaccacagacacttgtagttgaacaagctgagttttttgcttgatgcaacaagaaagaacacacaccatgagacatctcaataaaggatagaggaaaggacttataggatttgggcttccgttagataacatttggtagggttaaaaaatagacctctattctggagtgggtgctgttgggaagtagtaaaattcaatgattaataacttaatatttcttatctatatgattgaatgagtctagcctaaagctctgataggtaaagaagcagcagacacatcactcataatagccaaagtatggggctacttggccatttttgtgattaggaaaatgttcataattttatctatgttctaacatgattgtgaagttttcctatatttttcatgttctattacattcacactctggctgggtctgttgtcggtatactatgaaactgtatatgctcagcaggaaaataccaaatcctagatggcagtaccaggctggctcctgaatgccagcaacagctttattctttcttaaatctgaaacactagctgtgcttactatgaggaaatatatgtctacaattaattccatcttcccaaagtttatatccaaaataaaaagcatactatattgtgctaaggagattttttttcttcttgttcttcaaagcaaaatatagtttcacaggtaaaaagatccttagaaatcatctagtaatctaatcctatgttgatcagagctctccacagaaacaaaaccaataggatgcttgtgtgtgtatgtgtgtgtgtgtaaatgtgatttatttattttttttgtaagggatttgttctgacaattatggagtgtgaaaacccaaagatttataggcagcaagctggaagcccaagagagccaaggctgtaagtttctactctgaatctcaagacctgagaaccaggagtggcaatggtgtaagttctagtctgaaaactgggaggctggagatctaaaaagtattcatgttttagtacaagtctgaaggcagaaaaaagacttaagttttagctcacccagtcaggcagaaagaggtcccctcttaataagattagttctattcaggtcttcagctgattgaatgaggcacaccatattgtgggagccaatctgctttactcagatgcaaatattaatgtcattcagaaacaccctcacagacacacttagaagaatggttgaccaaatggttggacatcctatgatccagtcaggtggatacataaaattgactattaaaggcaggatatggtggttcatgcctgtaatgtgaacactttgggaagtcaaggtaggaggattgcttgaggcaaggagttagagactagcctggacaacatagcaagactccatctctacaaaaagtaaaaacaattagctggctgtggtgacacaaacttgtagtcctagctacttgggaggatgaggcagaaggattgttggagcataggagttcaaggctgcagtgagctatgatcacactactgcactaaaacctatgcaacagaataagaccctgtctctaaagtaaaattaaattttaaaaaagaactgtcacaaagcccagttgggaaacaactaaaagtagtagtttagaaatcagggctccgtgtacggttttctggatctttagagagtaatcatctcactagtgcactgttgttactgcacagaaagtttgtagagaaaattgacctgcttagaatcaaagtttaacattccattccaaattgagaaatgttgacaaaaagaatcaaaatttgtaaaatatttcaagagattgactctgagccaaatatgaggaccatgacctgtgacacagccccaggagatcctgagaacatgtggccaagctgattgggctacaggttggtttgcacattttaaggagatataggacatcaatcaacacatgtaagatatacattggttccgtctagaaaggcaaggctactcaaagtggtggtgggggtggggaagggggcatccaggtcataggtggagttaaagattttctggttggcaattggttgaaatagttaggctaaggacctggaatcaatagaaaggagtgtctgggttaaggtaaggggttgtggagactgaggttttcatcatgaaaatgaagcctccagttagcaggcttcagagagaatagattgtaaatgtttcttatcagacctaaaaatatgctagactctttaattctttcccggatcagggaaaagacctagaaagagaaggggattctccacagaatgttgattttccccacaagagatagctttgcaggaccatttcaaaatatgtcaaagaaatatattttggggtaaaataatttctttcagggcctgctatctgtcaagagtgtgttttgtaagccctacggtctctgttttaatgttaatgctggtcagttgtgcctgaattccaaaggaaggagggtatagtgaggcctctactagtttttcaggttaactttggaatgcctgtggccaagaatgggggttcattcagttggtcagggggcttagatttttattttttggtttacagaaaccagtcgcaactgctcactctctgttcttaacaagtatatctactctgaggaagttcaagagatggcattacatagacaaacttatacctctaggcaatgagattttaaatatttttcaagtttattaaatatctgagttttgagagatttaacctgagccccattctgattcttaggcattggatcttgcagattgttggcaaccagttgggacaaatagtagacaatagaattaaaactgggttcaagacagtgctgaccagggtggcagtgaaactgatataggtgtaagagaatgagtcaggagaaagagactcagaccaaacagaaggctctcttaagagaaacagggcaattaaactttaatcctggcttcacattcccgatacaagctgtgccctgggaaacacaggtaacatttctaccagaggctaagaagggatcagagcaggcacatgataagggtgttggagttatcaaagtatgaattttaaaaacccatgcacaatggctaatctgacaagaactttgatgaaaaaaagtacacaatatacaagaacagatggataatgtaagtagggtgatgaaaattccaataaaaaggacattctagagatcagcagcactacaacagaaatgaagaatgcctgtgtctctgagcttgaggatatgactatacagcctttgaaagtcatatgtgactctagttctgatgtttgttcactttcttcaaactgtgtattttgccttttagtatgcccggtaattttttgttgaaaggcagacacaatgcagtgagtaaaaggaagtgcagtaaatagacctttattgatgtggtggtaaggttagggggtgggggaacattctatagttctatgggtaggtctcagtcttttggtgagcctgtgcctctggacttggacttcaccagtgcttctcagtgtgttggctccccttccccttaagtggtacaggatggctactgcaggcaggacttgggtatttcccccgtcccatgtggaagggtaatgctggctgaagttgggtattcgcctttccccaggtcagttaggctctgataaaaccccagaagattaggctctggttgactagtttctccagagggtagacattattaagaagagtgggacacggtggttcatgcctgtaatcccagcactttgggaggctgaggcaggcagatcacgagatcaggagatagagatcatcctggctaacatggtgaaacctcatctctacaaaaaattagcctggcgtggtggtgggcacctgtagtcccagctactcaggaggctgaggcaggagtatcagcttgaacccgggaggtggagcttgcagtgagccgagattgtgccactgcactccagcctgggtgacagagcaagactccatctcaaaaaaaaaaaaaaaaaaaaagaagaagaacaggatgctctggcatatttccaaaagggtcctcctctcctcccgcttttggaaacacaaggcaatttctctccactattcactatgaggtctagggagtaaatctcaaaaaagcatgggggtccccccaggactgggctcccctggagtttttgtctctcagtcttgatcccactgaactttcagcaattcatcaattacagttcaggtttctccgcatcaacagtggttccccagggtgtttctgcttgtgggcttctgctgtggttaacttatgattcactgtatccctttgtctgtctctccaattctggggcgggcagcagtttgccttatgatctcacttcagtgctgtatctataaagagctgttgatttttcagtttgtttagctttttacttgttagaatgaaatgacagcttccaagcctgttacctgacagaccagaaaccagatgttgttgtcttgtcatatttaattgtgttccataaattgtgtatttgaaaagttgtttgtaaaaaaataactgcaaaactaggatgatgctgtattttttcaaagagcatttggttttcttttgtcaggtacttgtacaaaattgcaatgttattactgcagtccactttcaggaagtgaggtgattaaaagttaaggactttcacttatggttccaacccaaagagtgaaaggttcacgaggggtttttccactagggatcctgaaaggcttcaaatgtttcccctagactttcaaggctgtgaattcaccattcaaccatttgtcttctcaggcaccctaatgacacagggaaaagcaattccagatgcaggatttggaattgtatcttccttctcctgtgtttgagttggctatttctcaaataccttcaataaaatttctgagacatattttttcaagcagctttgtaaatcctcattaggacagttgatccgtatcatctggtataccattacctcaaagccatgcatgtttaaattgtgtttgcccatccacttgatccactgaattcgtgctctgtcagacgccatgtcctgctcatgtttatttccagagtctagcacacttcctggagttctgcgtgcacgtcacacatgtattaaaataaagagtgatgaaaagaagcaaggaaaaaaagagacagtagccatcaatcatttcctaggaggctaacaggcaattgtttcccataataacccaaagtgaatatgattctttttcctgagtaattccaggtctacccatctaacactgcctctgaaccaaatctttccttgccttatagatactgcttatcactacctatacatatgtatctatctttagaaacatctctgatcttcacagcttacatagttgccaattacgtgcccaaggtttgagatttatttatgatctataattaattctgtaaaaagaagtcaggtgtttaaaacctgaaaaatctttaattttcacataattccatgcttggatcatgttaataatatatttataatacttttagagtgaagcgtgtcaaaataattaactgaacgattgtactttgtggtacaggtgtgaaaattgaatagatgtcctttgatagactgtatttcataggtgaaagaaaaaattatctattttttcattaaaatatcacaattttcctgctctttgtttagtggctgttaaacttctatgtcataataactctttttttgatttacctcttctattttgtggtatcatttccccttcaaaacccaagagtgttcattataccctgtggcaaaggaaagttttctcagtaagcaacagcagttaaaagtatatagtttaagttgttgaaataaggtttaaattcatgatttaatcaatagagagggtacaggtaacatggttatgtttgcagcatttctgacttaatcactgagttaaaatggctctgctcttttaaaaccatacttcaaaaaatacccttaggtctttaaagattctaagacatgaagctcataaacttttcattttctagaatcaagaggagcctccagcatactttgactgataggtttctacatttcaagtacccatttggtacctaattcactcctggccatcagactcccctcccgtaacactgtcaggcacacgtgaaaaactactgcttcagaaagttacaggcagagggcagatgaatttaactgtttcctaccactatcattgccaagtgagaatctaggtccatacctaacagcatcatgacaaatatgagaccacatgcatgctccatttatccaacaagggtgcacaggatatctacctgtgctcatgaaaaagatcaacataaacctgcccacatagaaattatcatctaatacaggaacccagaaaaaagcccaacacaaaagcgtaaaaattagtagataaagaggctacgaaaaggttccccgaggtggtgacaattgagatgggattgagaagatcaattagaggtaaccatgtgaagaaactggtgatggagacaatggcttggatgcagcagttagagcaacagacagaaaagcaatgtggctagaaagggatggaagatgaggccagtggggctgaacgcacccagatcaggtggtcttgtagaactaggaagtccaggtttgattttaagagcaatgggaagcttatgaagttttaaaatcgaggatgctgcttacctttttaaaagttctctgttgtgtgaggagaaggttttataggaggatataagtagaggggtgcagcagtggcctggggaagtggtcatggttatttgggctagaatgatgtgatggtttattttacttttatgtgtctacctggctggatcattcagccaggtatttggtcaaacatctgtctagatgtgtctgtgaaggtatgtttttagatgagcttaacttgtttttatttttattttttaagagacaatatctcactctgttgcctaggctggagtgtgctggtgtgatcacagttcattgtagcctccaacccctgggatcaagtgatcctcctcccttagccttccaagtagctaggactaaaagagcatgccaccatgcctggctacttatttatttttttatagagacacggtcttgctatgctgcccaggcttgtgtcaaactcctgtgcagttagcatttaaatcagtagacttggagtaaacagattgccctccataatgtcagcaggacttactcaatcaattgaatttcctaagagaaaaagactgccttctctgaaggagagagaattctgtcaggagactgccttcgggctctaactgcaactcttccttgagtctccagcctgctggcctatcctggagattttggacttgccagtcccatagtcttttaaaatcgttctctctgtgtctttgtgtgtgtgtgtctctgtgtgtgtgtgtgcatgcatgtgtgtatgtgtatctgtatctatatctatatctatatctatatctatatctgtatctatatctatatcttagatacatagatatcttctattgattctacttctctggagaactctgactaatataactaattacagagacatgcagagaaaagggtatattcttcaagaggttcagggattaggaacacagatatttgctgacatattgccagtgggggatctgaaaaagagagaaagtgaccttagctccaaaattcgggcctgagcaagtgaaattcagtggtgccatttgccaagctgaggaagaaagaggagagccagagtgtgcaatgcggtttcagggaagaattaaagaatgctgtcctgcacatgctgagtttaaaatgctgatcattccatatccaaatgcatatatctagtggccaatggtatgcatggattaatgtataaaaggcatcccggggctttagaaagagcatagactttgacattcattatcatgggttcaaatttcagctttgccaatttacagtatctgaatagattacttataccttttgatgcagattccctttttacatttgagataaaaataacatccacgtcacagagtttttttgagataacgtattgcaaaaacattgtatcttagcatagaaagatttaaaatgccacataaatgtattatgtgctcacaagaatatttgatttgatggaaaataaatgcctgagacaatgctgttggttgtcttcctcattgattgttttcacaagtgtaaatttaaatacttacatagatgacaagaagcctctagtgttgaagtatagaaactggtcaccttccctgggaagggggcaaccacagtaaagagtcacctgatgagcttcaggaaaggctggtaagccagtggacaggacaggtaggggtcattgtttgatgtctggcctcaaggcatcaaaaaagttcagtccctgcaaagaacaggggaggaagagctccatctgaaggatgatacataatcagcccagggcccgtgggtttctcatctatggtaaagcatatttttccttcattttttcccttaatgtaggtgaatcgacactttaaaaagatagaataaaaataaaacacaagaaacataattttagaaaaacaaaaatatgtaagacaaatcctaattatttacaattagatttatcccactgatatggtttggctgtgcccccacccaagtctcattttgaattcccaagtgttttgggaaggacctggtgggaggtaattgaatcatggaggcaggtctttcccatgctgttctcatgatagtgaataagatctgatggttttaaaaatgggagtgtccctgcacaagctctcttctcttgtctgctgccatgtgagacatgcctttcaccttccaccatcattgtgaggcctccccagccacgtggaactgtaagtccaataagcctctttcttttgtaaattgcccagtctcgggtacgtctttatcagcagcgtaaaaatggactaaaacacacatgtaaaatgagtctcaaaaattcctgtgaaacatattaaatgatttgtctgaagttttgcatttgtctgggtctgtacctgtaacaactaactcacaaactgtgagctctgagccataactggggaaatgtcatgtaggaagtaattctcagaaacatttgaggtggaggcccggggaacagatagaatttatggtaatttgttaaataaggggttagtattgctgtaatttgggtattaagaggcagatgaccctatgttttagccaagggcaagaggtctggggaagtcaggtcttatcctcactaggtgacccaggccttcacccgagaagcagggcagagtgggaagtggcaggtgtcgtgtggccatacttcacccccaccatgcactcctgttgtttttgtctgggagtctggccaagaatgagagaaaagcaaaagatacacttcccacaggccaaatctgtttatttttccggtaaaacttggcaagggcttccagcttttgttcttctttaaggatatgataaaagataattatatctacatgttggagaaccagctttatgccatcagaagccaaatttctggacaaaagacaagcataaaatctggtgagcagcagacagctggcccacagttagcccagagccaagcccaggggaggtcaacacagggtcaaaggggataggccaaagattggtgaggtgaggggtggcaacacttgaggctcatgtttctatggctccacagtttactttgttggttctagaaaactccgttgttaactaacaaaatcttaattagaataatcaccctagtaaaatgccaacaaataatatcactttctctgaaagaagactttactggctaagaaaggaaacagttaattgcttgagccttcacaacagtaatagatttgggaacaagagcaggtaaccaaactggttatactgggattggaaccaggaaagtttaattttgcccctgacatgttgggcaggaagccccatggctttctgtttcctccaagaggtcatgaagcacctcccatttccacgctgctctatccagagcttaccctggaggggtttggatctgatccgggccaagtgcagaaagccaggttgggtcatggagtacagaaatcatatctaggttactatttattgaaacgttaaaaaatatttcagttcatttgttccttcacttcaacttgaggtagctaaaataaataagtagacaataacagaatcaaggcaaaagtaggaagtgtccagatggatataaaataaaaataaaaactatcagcaagctcatgatgacatatgaaatgcctagcatagagtcatgtaagatttctagaaattgggtatgaatctatttctaagaccctaatagacaacatcagtgggaaatcattggtaattagtggagtcttgtaactacatgtgcaaactgcagaagttcccccatatccgtaggaaatattgccaagggcccgagtggatgcctgaaaccacagatagtatcaaagtcaataaatactattttttcctataaatatttatcagtggtaaagtttaatttataaattagttacagtaagagattaccaataattaataataaaatacggcaattataacaatatgccagcatcactactcttgcattttggggccattattaagtacaataaaggtgactcggacacaagcagctctcattaccatgacactccatttgatgactagataactggtaggtgactaacagacaagagcgtaaacagcatggatcctctgggcagaggtgccgttcaagtcccaggacagaccaagtggtatggagcaagatttcatcattggacacagaacagtgtgccatttaaaacgtattaattgattatttctggaattttccatttagaattttcaaactgttgttgaccatgagtaactgacactgcagaaagtgaaactatggatatggcggcacaggggtgttactgtaactaaatgtctggaagcattactttcctgaaatgaagacatgagaattttgtatgcggcctcataaaggagatatagtgtgatatagagatatttgactttctgttcttttaaatgctaaacaaaaagtggttttcaagtgaattgatctcatagtacataaaaatattgtcatttggctgcatgattgatttaaatgcagtaactatttgtcaggcattatgtcaacttagaaagtagtgcagagattattttcttatttaagtgcattagaatgcatatgtagtttagaaatgcaaatcatttagacacactccataacaaactctggctttattttaaatggttataatagaatccctttcacataagtaaatatttcacataatatttcacataagtaaaatattatgattccaagacacagatcttctgaaaatatttgaggggtctgacctgtggaggtgttacatagaaacgtgggctctatttgaatgcaaagttaaaaaaatagcatcatgaaggactttttcttctgctgagaccccagtctaaggaggaatctgtggctatcttttttcctctcattctaatacacagggcagttttgttcttctagtgcattttgtggaaaaaatggatggtgcatcactttgattcacagttctagtaggacagttttttcactgctgcccctctaacacttctgaatgaattttaatatggtctctgtccaagtgccctttttagcaaagtaggtgtggaagacaatggatttctttttctttactagctaaaagtgagaaatataaaaaatacctttaaatgtggtgtgtgtgtgcatgttgatagctgaaatcaatcatctgtcatgagaagatattttattgcctatgtttcagtcagtgatattttctttattcacttaaaaattgtaaaaaaaataaaatgtgccatagttcctctattattagatttctttccaagccatatctgtgtaattattttacataattataacgattactcacatactacataatagtagtttaatagtagttttatattattaaatttttattgcactttcgttatgtaatacttcacaaatgtgttttcatgtctttcttaaaatcattttaaggggtaacatatcataatttacttccatattctaggagtgctaagattgtttccagtgttcacttccacagtgaacgttctgttgcacggccatttactgtgctcagcagcagctctccttgtgtcattccatttaggacctaactgattcaggacactgctggtctcaaaagaggaaataaaagacatggctgaacacctcactgtctcctagaggctcttctcaggagtggcttccataacttcccatatcatctcattcagcacagcagttcaggtggccaaacctgaagttttcgagtcagaaagtaaaatccttccccatagagaggaagcgactcatttgaacaaaaatacaattgagtacaaccactacactccactgcttctttgagacataactgattacattttaagagagcctccaatgcccaactacatttattgtgtgtgaggtctgtcttctttcctttcccacttcttagctaaaaggttcagataagcaatatcatgatgtcatctttcatattaatattaatttatctgatgaattgtgccagacattgccccttaagtaagaatctataaactacactaggcttagacataatttggaaaaaaaaatctagtattgcaagaactgtgttatagatccattaattttacagctaaagttgatatgaacacatgtaaaaatcatatccaaagcacagcagtgtcaagatgtaaagagaatgcagaaaaaagaatttctgcggctcttttatgtatttatgccatatttccctttaggattcaggccttgctttcccaatcactagcgaaaagcagtgttcattatttgatgactaaacttttttaaattttagtcttttcaaaatatcaatcatttctaaattcatcaagactcttgaataaaatgatgcacaagaagttacatacaattgatagtgaactaatatttcagtgatttgtattgtccagaatcttactgtatttgaggaatagtgaggactaaatttctcaatgactatatttgctgagagttgccacttaatttctgaccttagtattttctttcccctttctaacaacagaaattctgtcttctgcaaatattttctataatatcacaggctaactctcagtgtttttttttaatttttttttattatactttaagttttagggtacatgtgcacattgtgcaggttagttacatatgtatacatgtgccgtgctggtgcgctgcacccactaactcatcatctagcattaggtatatctcccagtgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgccgcaataaacatatgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaaaagtgtaaaagtgttcctgcttctccacatcctctccagcacctgttgtttcctgactttttaatgattgccattctaactggtgtgagatggtatctcatagtggttttgatttgcatttctctgatggccagtgatgatgagcattttttcatgtggtttttggctgcataaatgtcttcttttgagaagtgtctgttcatgtccttcgcccactttttgatggggttgtttgtttttttcttgtaaatttgtttgagttcattgtagattccggatatgagccctttgtcagatgagtaggttgcgaaaatgttctcccattttgtaggttgcctgttcactctgatggtagtttcttttgctgtgcagaagctctttattttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccgttgcttgtttttctcaggtttgtcaaagatcagatagttgtaggtatgcggcgttatttctctcagtgttttttggtcatctttatgaattcaaattgtattagttgtgaaaatgagcatttgcaaagtaacttggagaaaaatgaaactttcaattttataataaaggcttatatttttatctattgcattaacattaaaacaattcacatgattcagattcttaagataaaaaaattactcatttcataatcctcttatatctctggttttgttttaaaattcagatttcagattcactccagaattatcttgtttctctcttctgttttcatattctcaccaatgactttttctacatgcatgtataagttttacatatttttaaccatagcatggctaacatttttcatccccatttggcacttttattctaacttataaatattttctcatgttaatacatggtctttaatatcattagtgctatacaagattttaccagaccaatgaaccactattctgtttgagtcattaaatagcatcctattattggagctctgccttgtttccaattctttgtaagcagacagtgctataatgattatttttatttctattggtgtttttagcttttatttttgtttgcaaaagtatcttacagtagattctcaggaatgagaggattgagtttgagcaccttttcagctcttgaaatctatgccaaattgcttttctaagtgagatgtaccaatttatagccacaatctgtatgttagaatgtgtgtgttattgcagcattgtcaatcttaattattagaaattggcttatgtaatagataaaaaatgttaacgaattttgacactcctgggtttaatcaggaagcgtttaaatttgatgttcctgttttctattgactaaggttgttactattattgttagtggtagtatttgtagtaggtgacatgtttccttgtgacctttacctcccgaggtcttgaccttctgtaacatgtaagctgatccaactatcttttgtctcttttagaaatagtcttttaattatatagaagtttaatcattttatatattttaatgtttatcaatgtattttgtatattagtcagaagatggaaatcctttcagtaatttaaagaaaaagaatttattattaagaactgctaacttggtataaagatgttaattactgaatagataaagagtggacactaagttgtcagggagttagcagctaaaggaagctatgcttacctctaaagctaaggggacaaagggaaaaaagaagtgtggaggttatattctgccacagagagaaactcagtcctctgagtagagaggactgcgtgctgcagtctctgggtctagagaaggtgctgaggagctgcaaccctgaccttcccaaaggaactgcagccacaggagtgaagatggatgtgttaatgttgtgctacaatgggaattaaaggggacaaagtactcctgtcacttctccagacttgcagttccttcgaatgccctctcttagtggaacataacagaagccaattggagagcaaaaatgcagcttgtggtgttccagccccagcatcacaaagcagggtatagaagattgtgctcaagctgagaatcaacaacagaatgacaatcattacatatactggaagaagttgggggtaattatttgaactctgttaaataaaacaattattctgaaactcattaaaaaataagaaggctttattcaagaccatcagaatacaggagagagatcaggctcaactcaaatacagcaaggacaagtgggggttgacagccaataaagtgaaggagttcatgggtggaaaattactaggaggagacatcaagggtatggggattcttgctaaaccaacatgacaggattcttgctagaggcaggtcaagaacttgtacatcaaaggtgagggatgacaaatttgattagatatcaaggatggggagatccttgctaaactgacttagcaggattcttgctaaaactggactaggaaggccaaaagcaggacaggggccaaggtcaaggcctaatttagaagagggttcagcagagcctgactaaagtttaatcaagaagagaatttttgccaggaaaaggttgagggtcattatttgagcttctagaaattgatatggcctctatgtactccttcatcctacaaggagagagagagagatacatgtgtaattgcttatttatgattttatagcttccttgtatcacaaaggatttgatattacttgcccatgttaacggaaaaaatcattgtgtatctggatctgtttgagattttcagatctacttttcttgaataaattccatatccctgattaaatttcagaagagatattcaacagggcacatactagtttaacgtattgttttttatttatttgtttgtttgtttttgagacggagtctcgctctgtcgcccaggctagagtgcagtggtgcgatctctgctcactgcaacctctgcctcctgggttcaagcgattctcctgcctcagcctcctgagtagctgggattacaggcacccaccaccacgcctggctattttttgtatttttagtagagaaggggtttcaccatcttgggcaggctggtctcaaactcttgacctcatgatccacccaccttggcctcccaaaatgctgggattacaggcaagtttaacatattgttatttccaactaggtattcagtttattgcttttaaaaaaatattttttgattaattgggatagatacttttacacacaaaagtggtaccatatttaagtgaagtaggaggcactgggctaagtatattccttattaccatacacattttttagagttttatgtgaatgctgggcttccaaagcaccacaggcccctgttaatgccatcaaaatttaggaattcttagaattagcaaattctcctttattgctcctaaacataaagattagttgaaagaataaaacaatgaatgaataagtggaactctttttacgatccaaccactaactgctggttttctgtttcacccctattcctttgagtatgcacacacgtattatgaaatcatgtgatatgatatatttaatcatatgttttaaacatattaccagatcataatgattgttctgtattatcatttaaagttttcacagtgtttcagtgaattccatttcagatgacagtgttatttttaattgtttttattaaaacatggctccaaaaactttcatttttagctccacatgtaaagagcttaaaagttgtcaaagttgtcactctgtccttaaaacaggaatgaaactgcatagagtaaaagtcaacagctttttttgggtcccattagagaaatgaggtcatgagacaaacagccaccaccaaaattggagagacagataactagagacaatcacagttgagatcatcttatgatgagcaaaagttggtaggaagaagcaataataaccacaagttggtaggaagaagcaataataacttccaccaattgatagaggtggtatgagtaatttctggggtctgcagtcttagaatagcacacttttattgattttcctctatgaacttcacaagttctaagtaaccattctgaaatatattcagagtgttctctgtagcaaaggccagaactcccagggaaaggacatttctagatacttatctgacatggagaaaggacaatttcccaactccagccccatctagccttccagtttcacctagggagggtaagaagcagtgaaacatttccaatgatatcacagcgtagggaaacaggtgcactaagagtttcagatttagtcataagaatatagaatgatcccctctgccactcctaatcaccctatcaacagggcttcaatagaataacagcaggtttcatcaaggctcagactctaaggcattcttaggaaaacccaaacataacaagggagacagaaagacagtcagtagacagaggacattggagtccctggaacatacagctaccacagacatgaagcacacctcaactcatagccagagggatgtaaaactcatcccaaaggttccacttatctaactctagtatctgatgtgtcatgtctggcttgcacaaatagttgcaaaacattcgaagagacaagaaaaaacaatgtctgaagagaaaaaagtaaccatgctcagatatgacacagaatttggaataataagacagtcaatttaaataattatgattaatatattaagcactctcataagaaatgtaggctatatatatatatatatataaacatagcagaatacacatatccaacatctgcacaatttcaagagctatgaattaaattagaaattattggaacaatagaaaaagaaaaagataagatagctgaaaaaaatattcaaaatatatagtaatgctgaacaggtttcaaaattaatgatgttcatcacactatattgccagaaacctcagagaaagctgaggtggataagtgccagataattgaaacttaggcatattgtatttatttatttattttctcaaatttgttgagggataatgacaagtaaaaattgtgtatgtttatggttttcaatatgaagtttttataaatgtatatatcatgtaatgattaaatcaagctaattaacctattcatcacctcacatacctattttttatgataagaaacacctaatttcttagcaatttttaagtgtatcataaattgttattatttttaatttattatgtatatttgaggtctacaacatgatgttatgggatatgtattgatagtaaaatggctattatagatgaagcaaatgaacacttctatcacctcatgttacttttttgtgtgataacagcagctaaaattttatttaacagaaagcccttataaaattttattaactatagtgctcatattatacattagatttctagacttatttatcgtacacttctgctgctttgtatcctttggcctatacttccttcttgttcccaattcccatcctctagaaaccattgttttacattgttttattctctctgtatattgtgtatatttgacctcttttttagattccacataaatgtgagatcatgcaatgtttttctgctggtagtttttgtgtcttctttagagaaatatctattcaggtcttttgctcattttttaatcaggttgtttttctgctgttgaattttaagtatttttcacatatttagggtattaactcattatcaaatatatggtttgcaaatattctttttcccaatcttaggttgcctttccattttgttgatggtttcctttgctgtgtggaggctttttagtttgacgtagtctcttttatttatttttgcttttgtagtctgagcttttcgtgtgatttgcaaaaaattcattgccaaggccaatgtccaacagctttttccctatgttctcttctaggagttttaggatgtcatgtcttatctttagtttttttatccattttgcattgatttttatatatagtataagataaaggtccaattttattttttgtctgtggaaatccagttttcccagcatcatttgtggaagataatgttttatccccaccttctcctcttggcacaaattttgaaaactatttgactgtgtatgcctggatttattttgttcttctgttatagtagccaaacaaattaggagacataccaagtatcttttctgactgcagtagaatgaaattagaagtcagtaacagaaggaaaactggaaaattcacaaataagtgaaaattaaacaacaccctcttgaacaagcattgggttaaagaagcaatcaaaatgaacattagaaaatattttgagtcaatgaaagcaaaaagcttacccaaacagataagatatagaaaaagcagtactaagaggggaagtacatggcaataactgtccatattaagaaaaaagaaaaaaaggtaaataacttaattttatacctcaaagaactaaagaaagaagaacaacctaagactgaagatagcagaaggaaggggattttaaaaattagatgagaaatatgaaatatagccgatagaaaactaatagaaaaaacaactaaactaagatttgggctttcttttaagataagtaaaattaacaaactttcacacttactggaaaaaaataagagaagactcaaataaaatcagaaatgaaagagatgtcatcacatctgatggcaaagaaataaaaaagatcataaaagactacagtgaataattatatgtcaacatgtagaaacacagtgtaccaagactgaatcatgaagacattgaaaatctctctcaataaagaaaagtccagcaccagaaagatgcactgatgaattctaccaaacacttaaagcatgaacagtgatccctctcaatctctcaaaaaaaaaaaaaaaaaattgaagagtggggactcccaaagttattttatgaggctagcatcaccctgataacaaatacagacaaaaaaaaaccctttacaagaagagaaaactacaagtcaataaatattcctgatgaatacagatgcaaaaaacctcaacaaaatactagcaaacttaattctgtagcacattaaaaggatcatataccataaccaagtgggatgtatttgtggaatgcagggtgttctaacatatactaataaataaatatgataccatacattagtagaatgaaggataaaattacacaatcgtctcaacagatgcagaaaaagcatttgacaaaatccaacacatttttgtgataaaatctctcaacaaactatatacagaaggaattttttgtatatgaaaagcccacaaatgacatgatctataacagtgaaaaaataaaagcattttctctaagatcagaaacaaggcaagatgaacactttttatcacatgtactcctcatactactgaaatttctagccaaggcaattaggaaagaaaaagaaataaaatatattcaactgagaaagaatgaagcaaaaactatcgtttggcaggagatgtgattttatatgtagaaaacatgaaagactacacacacaaattttcaaagtgatgttgggcaaaaatacaaagctggagacatcacactttctgatattaaaatacattacaaatgtaaaataatcaaaatagcatggtactggcataaaaacaaacacatagaccaatagaacagaaaatagactttagaaataaacccaggtatatgtggtcaatggatcttcaaccattgggtgccaagaatacacaatggggaaaggatagtctcttcaacaaatgatgttgagaaaattggatatccacgtgcaaaagaatgaacttgatctttatcttaccacatacacaaacatcaactgaaggtggattaaaaattaaatgtaagacctgaatctatagaactcagagaaaaacaaacaaaaaaagacttaatctttgttttaggcaatggtttcttagatacggcaccaagagcactggcaagaaaagcaaaaataggcaataggattacatcaaactagaaaacttctgcacagcaaaggaaataatcaacagattaaaaaggcacctacagaatgagagaaagtatttgtaaaccatatgtctgataaggggttaatgtttaaaatatatacaaatctttcacagctcaatagcaaacaaacaaacaaacaaacaaaaaacaaacctgatttaaaaattggcaagataggccgggcgcagtagctcaggcctgtaatctcaggactttgggaggctgaggcaggtgaatcacgaggttaggagttcaagaccagcctggccaagatggtgaaatcccgtctctactaaaaacacaaaaaattagccaggcatggtggcaggtgcctgtaatcccagctactcgggagcctgaggaagggaattgcttgaacccaggaggcagagattgcagtgagccgggatcatgccagtgcactccagcctgggtgacagagtgagactccatcacacacacacacaaaaaacacataaatagatatttctctaaagaagacatgcaaatgaccaagtatataaaaatatgttcaacatcactaatcatcaggaaaattcaagtcaaagccacatgagatatcaccttattgtgtttagatggctgttatcaaaaaccaaaagataagtgttggcaagaatttggagaaattggaacactgttagtggaaatgtaaaatggtacagctgctgtagtagtttgtcaaaaaagcaatagtagaactaccatatgatccagcaatctcacttctgggtatattttttaaaaattgaaatatatattatgataagatattaatactcccacatttatttcactgttattcacaatagtcaaaatatggatgcaaactaaatgttcatggatggatgagtagattcaaatatgtgacatagacatataaataaatattattcagccttaaaaaaaggaaatcctgtcatatgtgacaacatggatgaacctgttgatcattatgctaattgaaataagcaggtcacagaaggacaataatctattgtttcacttatgtgagaaatctaagttagtcaagctcatctaaagagagtagaattgtggttgccagaggcagggagagggtggaatgggaagttgttgttcaatgtgtataacatttcagttatacaaaattaataagttatacaaatctgttgaacaacactgtgcctataattaacaatactgaattttgcacttaaaatttttgttaagagggtagatttcatgttaaatgttccttccacaatatgaaacagaaaccaaggtgaaataaaataattttttattcttcactgatccagcagataactcttaatttaaaaaaatagtggcagcattgtatatggtgactatagtaggtggtaagtgaaattaaccatatcgatatagcggacaggagagaggaatgggaatagtatattaaggtatctgcactgcccatgaagtggtataatgttaatggaaagaagacttcatttagttgtaaataggtattgcaaactctatagcaatcactaaacaaaatttaaagagataattattaatatggtaagataggaaagaaaattgagttatacaaaatgcttaactaaggtcagagaagacagaaaaagaaggaaaagagaaacacagggtaaatgaaataaatggaaaaaattattaacacagtagatattaaaccaactaaataaaaatcacttacatacaaaggtctaaatacaccagttaaatgacagagattgtcagagtgattacaaaataagaaccaactttatgttgtctatgagaaatccactgtgatcataatgatagaaataggtggcaaatggagagatgtccaacttatttttaagaatggtgctaaaataattcaatggggaaaataatagccttttcaacaaatagcactgaatagaaacatgcaagggaatgaacttgtacccttacctcacaccgtatacagaaattaactcaaagtggataagagacctcaatataagtactgaaatttaaaactgttagaataaagttaaggagataaatctttatgactttggaatcagctctggattcttagatatgacatcaaaagtgccaatttaaaaaaaaaagaaaaattggacatcaacaaagttaaagtctcgttttgcttcaacaggcagtataaagaaactgaaaagtaaaactcacatagaggagaaaataatcacaaaatatatctgataaggtacttatatcttgtgtatcctcacatgcaaagaactcatacaattcaataaaaagacaagtaacccctttaagaaataagtgaaaagcctgaatagacattacttaaaagaagaaatataaatggccaagaagcacatgaaaagatcctcaaaattattagccatcaggaaaatgcaaatctaaactgcaatgagataccactttacacctacactttacacctgataaatggaataaaaaattcagctgataacacgtgttggtgacagtgaaaaaattggaatcttcatacattgttggtgggaatgtaatgctctaagtcaagaacaggatcttgaagtttctcaaacagttaaacatagttatcaatataatccagcaatttcatcatagatacctatccaagaaaaacagaatcatatgacaaacacaacacttagcacacaaaaatgtatagcagccttattaatagtaaccaaaaggtgaaataaacctaaatgctcacaactgataagtggataaacaaaagtagaatatccacacagtggaatattattcaatcataacaaagaggcaaatactaatatatgctaaaaatgaatgaacctagaaaacattatgcaaaatgaacaaatccagtgacaaaagatcacatattatatgattcaatttatatgaaattgttctaatggacaaatttatagatacagaaaataaactagtggctgcttatggactgggatgacaggtggatagaatggtagtagttaaagggtatggagtttctttttgaggttaaaaaaggatctaacatcaagagtggtgatggttgcacatacctttgcatatattaaaaatcattgaattgtaccttttaaattggtggactgtatttctcaatgaagctattttttaaaagcaaagaattggagaaaaatataccatgttgccgccaatcaaaagaaaactggacaagctatataaattccagacaaatgaacttaatatcaaggaaaagtaccagagataaagaggagtattgcaaaatgataatggatcaattctccaggaagacataaaatccttaacatatatatacctaacaacagagcatcaaaatatatgaggctaaaattaacagaactgcaaggaaaatagacaaatctaatagtatgattacaggcttcaccatttcttatcagtaactgacaatttcagcaggtagaaaatcagtacggatatagcttaactgaacaacaccatcaatcaactggatctaactgacatttatggaattctttatccaacaaacaccagaatacatattcttctgaagctcacatagaacattcaccaagatagactacatgctgggcagcaaacacatctgaaccaatttaaaaatagaaataatattcagaatgttatcagaccgcagtgaaattaaactagtactgaaaaccagaaagttagtgatgaaccccaaagtatctagagattaaacaatgtactactgaatcaaaattgtgcaatacaacataagcagtctttaaagggaaatttatagcattcaatgaataaaaagaaagatttacaatcaacaatctaagctttcattttaggaaaccaaagaaggaaaaatgacacaaacctgtaaaaagtggaagaaagaaattaagacctaaagtataaatcaatgaaactgaaaatagaaaacgaaaagaaaatcaacaaaaccaaaagctgtttctttgaaaagatctgtacaatgtattaatccctagccaagccaatcaggaaaaaagagagaagacataaattactagtattagaaagtgaaaaaacacatatttctccattgattatatgtcctatttgaacaatgtaatcctcttatttatagttcaatgacaatttttaaaagagcatatagatcatattgttgcataggcttctggagccaattcaccttagtttgaattccagccttgccttttccaactttgcatacggttcagataatcttattttccttttaagttagattcatgggtgaatttttaaagatgatataatagccacaattaagatcaatatgtggtggtgtacagaagctcatgtcaattggaaagagtgcttgttcattttgtcaggaactgagcagccatggcataagtctcacctagatttgcgaccacaggtaaattaattgaacaacttgtgcttcagttccattagctgtaaaatgataatatgaaagtacagaatagtacatatattataacattaaattcttgagaatatgaaatgatttatgttgcttgacatacaataattatgtaaatacaattatataatcattcttcaatattttgatctacataagttgattttctaatattgagctgacttttgctttctgaaaaaaattcaactggtttttcttactccaatttatcttcattcttttacatttagtcatagacaaagggacacatataagatgaaagagaagaaataatttaaaaatagagttaacacagccctgtcacggcggctcacgcctgtaatcccaacattttaggaggccaaggtgagtgagtcccttgagctcagaagttcaagaaccccctgggcaacatgataaaacctcatctctattttttatatatatatagcaggagatggtggtgcatgcctgtggtctcaactactcaggcagctgagatgggagaactacttgagcctgggaggtagaggttgcagtgagctgagatttcaccactgcactccactctgggtgacagagtgaaaccctgtctcaaaaaaaaaaaaaaaaagaagaagtaaggtcaacacaaaagttaccccagagatgctcagtttctgacaaaattaacaagcactctttctaattgacatgaacttttgtacagcaccacatattgatcttaattatggcttattacatcatctttaaaaattcttccataaatctaacttaaaagataaattaagaattatcattgttaacattttgacacttcttttctgtcaatatgtttttaatgtgtttttcttaagcttggtatcatatatagagagaggtaattttgcaacccacttctttcaaatatcatctatgatatattttcctatgctattgaacggaaccttatagcatagaaaacaatgcaaagctgtgctaagttcccatgaggtcacttttaccccagagctgctcgggttcccagcaaaataaaccagcactctttccaattgacatgagcttccgtacactaccacatattgatcttaattgtggctatgatattatcttttaaaaatcatctgtaaatctaacttaaaaggaacataagattatcagaatcatatggaaaacgtgtatgggtcactcaattttgagcctgccagttttctgtaatggtgaatttctagtgatctctatcttttcttaaacaaaacacttgaaacttctttattgttactttcatcttaatcttctaattacctggctgtatgctaaaaattatgagtttctcttcttacaataagtatattttttcatagattcttgtaagatggacatttgacatgtaaaaaaataccattggttgcaaattttcactagtgagattatttgggaaaaaaaatatttattttacactttcaagaatgtcacatagaaatgaggttttagttacagaagagatcattagtatattcattttttattaatgctataaaaatttaccacaaacctagtgactaaaacaattcaaatatattatcttatatttttgtagattacaagttcaaaatgggtctcactgagctaaaataaaggtgctggaagggctcggttcctttccaaaggttctaggggagaatctgttctcttacatttcccagcttctagaggctccccttgttccttggctcatggtcccccttttttatcctcaaagcgacaagtgttgctttcctctgatccttctcccataattatgtcttccattaactctgctggaataggttcctcaactttacagatccatgtcgttagattaagcccacgtgaataatctagaataatctcttcttctcaaggtccttaactacatctgcaaatgtccctttttccaaagtccaataattttcaaagataaattaagaattatcattgttaacattttgacacttcttttctgtcaatacgtttttaatgtgtttttcttaagcttggtatcatatatatagagaggtaatttttcaacccacttctttcaaatatcatctatgatatattttcctatgctattgaacggaaccttaacagaaccttttgaaaggtaacaattaacatctttagttacaaaaaaagtgatgtattcaatttaaattttcattaaaataaatgacttttgggtttccccccaaaattctgacctatggtttatcctttgtgcatttaatgtgcttgaagatcttggctctttccaccatgcaagtcattaaagccaggtcatgctccgcagcatttcaaaaagtcatcatcacacagctgagaaatgacccagcaacagataacagaaatcccaccgcctgattattcacatctttcaactctcattacaggtcaattttaggccccacagagctattttagtgtggccacaactgccacattggatgattgtcaaatattctaactgtggctgtcaggaagacaaataaacaaaccctggatcaaaagcccaccaggctgtgctggctctcacagggctggtgctttgctttgagacaagccctttcccatttgtgacttgttatggcctccaaaatttatatgctagaaatccaatcaccaacgtgatggtgttaggcggtgaagcctttgggaggtgattaggtcatgagggtggaacctcatgaatgggattagtgctttgataaaagaggccccaaggagctgccttgccccttcaccatgtgaggacacagcaaaaggacagccatctataaaacaaaaaacagtccccctacagaacaccaaatctgttagcaccttgatcttggaattcccagactctggatctttgagaaatacatttctattgttgacaagccacctagtttgggatattttgttacatcagcccaaatagaataagacagggctctaccactaagattttgtttgtttgtttaactctgggcaaattatacaagcctcttttttcatataaagtggagatatctgacactttgagtagaatgatattactacatatttagctcaccagaattatagcagagattcaacaagtactagttctgaatctctgaccatctggtctaaagaaggccctgccttcctttatttcacaacatttattaatagctgtaattaattattgttcactatgtttacctaactttaaatttcaaaagtgctaaaatcatacctttcttatgtagccatgtgtacctggcacctagctcagtttaatggacttagtaaatgcttaacattttctcagtaagttagtttcctcttttcttagctcccttacatgtgttaaatccatgacaatcattcctaagaaacttgctcaccaaacttatgaacaatgacacacatttttaaacttattgcctgaattattgctggtgtcacctgctggaattagacagtgtagaagaaaattttgtagaaaaagttaaacccaagacctgaatatagatagccaggaatgagagaaaaagataaattcctgtctttacttgagactggaggaatttctaggctttaagagaggatatcagagcagagtcagtgctcttgcttcggtcaaagcaatgtgcctgcttttcagcatacagaaaaagaatatgctaggttgcaaagaggaaatattgttgtaccattctgaacaggtaaatcctgcttaagcatttaattggaaagtgaaaatgaaaatatccaaggagctatacttcacacttgaatagactgaaataattaacgtatttataaccaaaataggacttactattgtaagtaagttttggaacttgaacgttcattgtccaggtcctttccaaggctgtggagtggctctagcaatctctttacgtgattatctgttttgtaaagttttcaattccgtagtgtaatttattttttttcttccactaccccgagtagtttaggtatttgggcccatgttttcctcacttttttgtttcaacctgctggattatccagagaagttccacttggagactgggtacatcattacttcaagcaggaaaatgtcaagacactcaagaccctccgtgctgtgtgggcacatggctgctgggctatgaggctttcccttggacatgtattttcagggcaataatgaccacattctgaggagaacaaccaagattttaaggagatttgttgtggttgttgtttgctcagggagagactatttggaagaacagagggaacttgactcagagctagacacttgggtacataatgacactctggaaagactttcaacttggactacagaaatacaactgaaaataattctctcttatcaacctaaataagtcagttcaaatttatggtattccgtttgcttaatttgtaaagcataaagtcagaaattgagtcataataataatatgaaacctagtgttctttaagcctttactttgtgtgaagcgcagtgataattacatagaattctcagagcaagatgaattaactcaaaatggatcaatgacctaaatataggagaaaaacaatgaaactactagagaaaaacatagggataattctttatggccttcgatttgttaataggttctcaaattttacaacaaaatcaaaggcaacaaaaataacagataaattattcttcattaaaattaaaaaattatgtatcaaaacacattagcaagaaagtaaaaagacaacctataaaatggaaaaaaattgcaaatcatatttcgggtaaaaatttagtttccaaaatagaagtaccatatcacatatactaggatggtgagataacaataacaacaaaaaaaggaaagaaagaaaagaaaagaaattgaaaagaaaaacagctgaaattaacaagtgttcacaaaaatcaagcaaaataggcaccctcatacattgctttgggggtaaaaacatagtgcagtttggcaccctgctaaaagctaaacatagaattaccatttgacactgcaattctactcctagatagatgcccaagggaaataaaaacatacgtcaagttactatgctcacacaaaaacttgtacagcaatgcttgtagcagcattattcatgatagcacaaaggtgaaacaactgttcagcaagggaggaatggataaacaaatgcttgtatatacacacgatgaaatgttattaagccataaaaaggaacgaagcaccaacacatgctatagttcgaatgaacctagaaaataatatgctatattcctgtctttgcttgagactggagggatttctaggctttaagagaggatatcagagcagagtcagtgctcttgcttgggtcaaagcaatgtgcctgcttttcagcatacagaaaaagaatatgctaggatgcaaagaggaaatactgttgtaccattctgaacaggtaaaaactgcttaagcatttaattggaaagtgaaaatgaaaatatccaaggagctatacttcacacttgaatagattgaaataattaacttatttataaccaaaataggacttactattgtaagttttgaaacttgaacgttcattgtccatgtctttccaaggctgtggagtggctttagcaatctatttacatgattatgtgttttgtaaagttttcaattccgtactttaacttatttttttcttccaccaccccgagtagttctatatgctatagttcgaatgaacctagaaaataatatgctaagtgaaagaattcagcacaaaaggtctcagattgcataatttctttcctgtgaaatatccagaataggtaaacccatagagacaaacagcagattagtgattgccaggggatgtgggtgagagggaggaagggagagtcactatttaaacagtgtggagtatttttccggggtgatgaaaaattttgaaactaaagaaaagtggtggtttacaggattgtaactgtaccaaatgtgctatttgaaatagttaattgtgtataatgtgtattttgcctcagaaaatgctaagcatgatttagtatataaacaccttgaaaaggcagaagaaaaatcacattgttatctctaataaaagtggaaacatcattgggcaaaatccaacatccatttctgaaaaactttcagcaaaatagtaacaggagggaactcctatagctgcataaagggcatctgagaacatcctatcgctaacaccttaacgctgaaagatggagtgcttccctccaaaataaggggaaaaggcagggctgtctactctctcagcatacataggcaaccagctggaatatggttactgtcccctgtggcaaaggaacaccacagggatgtcctcagcacctccaagaaaaagagctgggttcagatagctgctgggtccacagagccctgcagttagatcagcccaatagcacccaccaaacaggaactttccaagatgattgcaaacggggttaacatgttttttggagagcaactagaggcactggatgagactttgtcccctcaactgactgccatctcccactcccctccccaagtcaggcttctgttgagggatggagagatgtatttcctttaaagcaagaattaagtattgactactacaaaactaaactaaactaaactggaaatgtgcctgaagtgaacagagtcaggtgtgtgtaccctaagagggaacagaaatctccggagcctatgggaggtttcacccaagaagccccatcccacacagtgggttaaaagagcagtgcaagatcaaatcaagttgcttcaggattgcatcctgcaagtgaggcccacacaagggcaggctgttactagcagagagaaaagggaacaattggtattgttctgcctacctaaataggcatcgggattgtgattttgggtcagaatttctcatataaattgccacatcatctgtttttcaatgttctttccattaggcaactcacagcaagggaagtaattctggagaagaaattaagaatttctatattccctggaaagtattccatcaaaataacacacagagtagcacccaaaataacacccctagtagcaaccatttttagaagccatgattcctaatgatcaggcttcctgggatcctcagctatccagttctagtttagacatacatccttgcctcctattgccactatgcaatggaccatggatgaaaatctgaacaagactgctgactgctctgttaaaaaagcctcctgcatcactgcttcagtctcttggcctgaaatgctccttctactcatgaagttaatatcttgctgccaaaacttaattcaaaaaccaccatctaccatgaagcctcctctcattctcacagcccaaatgtattttttatctcctttaaattctgtatgttttctcatccgtttctatcatagttttactattctacctatgttgcaaaactctctaagcttagagccatattttatacaccaaatttcctgctacagcagacggtgctcaataaatatttgttcagtgaatgaatgagtgagtgaatagagctgaaggagtgaattaaggaagagagttattatagcatttccctttacaggagtagaaataataagcgccattatggattgaaactttgaaaatataagcagtagaaagactgtgttgcaacagaagtcttataaccacagcctttattcaaggtatttcccatgtttctctacaaagctaataatactttgattcatcttcctaagagagttataaaataaaaaggaatgatcatctaatttaatatctgatgtaattccagtgatgtgtaatttactagcttcttagccctgaactgttttttagtgttagtaatcacatctgttctgcacctttagagaataaagcactgccaatcaatatatgataatgcttttattaaaatgttcaaagcagaaaacaggtcttacttactaaatacttcatcagttctaaatttattcagaactctttcctcaaataagtaacatgttttaaacaagactgtggtttgctttctccaatattcctttcattgcacatgtgttagttcaagatggctaaagttctttgctttcccctgtcttgtgttgatgaccatcaaatgaggaaacagatatctgaacattgatttctttcatctatttgactgatatttattagaaaaaatggtaataattgctaacatatattgaagattcattatgtaccatgtttctaacatttgttttatatacagtatctcattgagtacacattgccaaggactgtataatgtgatgggctaaaatatgttccccccaagatcatatgttgaggtcctaattcccatactttagaatgtggctgtatttagagatagggccattaaagaggtcactgagttaaaatggagccctttgggctggacctaatccaatctgactggtgtccttattaggacattgtccctggtgcacagaaagctgaccatgtgaagagacagtaagagggtggccatctgtaagataaggaaaggggtctcagaggtcatctaccctgccagcaccctgatcttggatttctagactccaaaattctgacaaaataaatttttgctatttatgccacccagtgtgtggtattttgttatggcagtctgagaaaactaacatagatactgttatcatctcagttttacagatgggaagacagaatcttgaaaaggtcacagtctagtctgtggtggagcagatgctaaaaccacagtctgagttcaaaggctacactctttgctattttctgttagcacctcctgacattaatatcaaattgatttaactataagattgtggcaggcactgtgctaagaactttggtgctttatcaaacctggttgctgatacacttaaaacatttcttagagtttccccatttgtgtttcttgctgctgaccactttattcctcagggctcttccaattctcttacatggactcttctctttttccatccttttctctttccccaccctgtgtctatgacaaagtcagtattatctgggctgtccagtgactctcccacagtaatttttcttgacctttttaaaacaagcccaagtcctttggaactcaggcatctagagatagatattggcctcttaacatagttgtggccactcgtggactgtgactgagtttcctgtattgaagcccagctcaccgcctttcttttcatgtcactcaaacaatgttctgtgcagtctgtccagattcagcagttttgtccctggacacatggtttgttgccaccctccacttccggtcctcgtgaaggcagtttcatcttcactcttggatgcctccctgtcttcctactgttccagagcccatgccatttctgagatcctctgagctgtccttgtggcttccatgcaggtgaacacaggattatcagggataaatgatcagcagtgggtgggccagggtcacatgtgagaagaaacaggctgtgacctgagagtgagatgctgaaaaaattgggaggtgaaagttactgcatttgagaattccaaggatcttagaagacagaaatctgttgaagtgttcacacggacacagaaatcggtcaatatgatagtgcaacataaaggcgagttctcaaggacccccattcctcctaatgagaagaagacacaattattattatactgtgtctatttttagcaaaataataagcatgcgatagtatagcttgttttatgctttgcttttcaactgggtgaaaatccatgcaaaatgatttcccaccttatttgagatctaaagtcttaaaatgcagagcctatctgtgaagtcctccgcagcctcctgctcccacccccctgtccgcttgctaaaaggtcatgcattttccttcccgctgcagggcctttgcacttgctctttactctgccttcaatgccctttgttcaactatctgcacgactcatttattctcttccttcaagactttgctcaaatacaattttctccttaaggccttttctgaatactctgcttaaaattgcaactttctgcctccaaatcctcttcctttttccaggctttgtatttcttcagagcatctatcaccttctattatatcatttacccatgtattttgtttatttgcccttgtctgcaatgttcagaatgacttatttctcccttattgtgttttttaatgtatcttcaacacttaggagagtgcctggtgcacatactaagtagtcattattcatttattagataaatgaataaatgatgtagggaagaatctttgtatctgcaactctttgctataatctgttaaatttttaatttattatacagttcaactatgaaacttacctttctgaataccagaaaactccttaccctttttaatctgtaaattaaccagattcttccagggattattaagtcattctggtgatttttataattgacctttgttaacctatgatggatgcatttgctacagttcatactgaagacttctgaaatttttctaacccatgctgcattgacagtttccatgactatatgaatattaccaaaaaaaatcctagcatatgtacgttaacatattatcaaaattgaggaagggaattagaaaaacaggaaaaagaaaagagtgcaaaacagtgatcacccataaattacctagctcaataaatgttaccatttgagtgtacacacccaccccaacattcacaaaattgcgattgttttgtttgttcacattattcctaagtcttttccctcctttttcagaactgttcctgacacctcaaatctaataccagtgctgtagaggctgtggggaattgtcgccgttggccagggcaagcctcctttgatggcccttgacattcacacttttggcaatatatcttattatggagtcatcagtgttcaatattgagaattttaaagatgtgaatatataaaggcatctataaaggcagaaacatcacatgtaattccaaaagtcaaaatgacatctatttcttgaaaaatttttagtatttacttctagaaatctatttacacattttcatttgtatatgtatcttttcccagaattggggtcacatagtacattgtgtttataacccactttctttcatgtaataataactgtgaagattttcatatccagttaatattcccacttactgcctatgtgccatttatcacctacaccaacagagttattaagaggactgccacaagtaaagttacagaataattcatctgaaagctaaattaaacctaaaacacatcatattttccctcctttattcatggtaaatgctgttatctctaccatttggcctccagcagcaatttatgttcataaagaatttccatccaggagagaaaatggcactccacttttcgctttcaattttttataatgtgtgatgtgcttcacaggatttcactgctttctctgaccacaaacaaacagtggaactgaatggcctgtgtctactgccaccctgcttgtacttcccagctttctttcatggttgtctctatacagaagacatgtaagcatggaaaacaataagatcataagcatgtcacagtaagatcatatggagtaacctttttctcactcttaattgcaaatgaagtttgtataatgaaatgtttggaattacaaattaaaaccaccagacaccatttcacactctgtttgtttgggagaaagtactagtcaatgttaaaaagatgtatgaactcttatttagagtttgtataggagacacatttgttacaatcactttagaagtatttttggcattatcttttcaattttaaaatgtatgtagccagagatgcaacatctccagtcatagcacattatattacctgaatgcttacatatttatgagggctaatagtagcagcatttacaatggcaagaaataagtaaataaagcagatgaaaggtacataaacacacatatggataaataaattgtggcgtattttctcaatggattgccccacagcagcagaaatgaattctgccaaaaacaggaaagaagatgagtatcacacacctttgttgagtggaaaaagccacacatgtatacggattcctggaaggttcatataccttgccccacatgagtggaacaaacaggacttgaattcaaggcctctaacagaagggtgcagctgctcaacggtatactaacccagcttgcgcagatgtgcatattaacatacaaggatcagtgggaaaacacatcttgagaatgacaaagggaaaggaggggatccatggagtgcagtcctgagggggcaggtgcatgatcagaaaaaacagctgtgccactcaggcagcaggaaggcacgtgggcatgggtgcagaccaaagaaagaggtcggagtggggacagagggatgaaggtactttgttaacttaatttggttgcaagttttgtattcaaatgctaaaacagagtaccaccacgttgtgataaaatatgaactgtaattcatgctccatattatcccactctggagtttccttccccaaactaacttttgtagctctctcttctgatatttatttgcataattactaaacattctgtatcactatttcttatgaaaaattttatctatgtactttcatagaagataatgatcatacactcataaaccaacctcacactatcccctcccattacctttctatcataatttttaaaacattatttaccatttaatttatagaaatgtaattcttaccactgatgatccttaaagttagtgtataattgaatttccttttctgtattttctcttctgtaaaatggcgatgataaaataaaaccttcttcatagggctgttaaaagtaaaagtgtgtatgtataaagggtattaaacagtgtttggcatatgattcaataaatcttagcttcatttactatcgaaaacccagaggaagatacagaaattgacagactcaggttaaattcaaagtttcttgacctctcattcaaacgctattcatagtatgccacattcttgcttttgtcacatataaatttaaatttttaaaaaagtaattgctttgaaatgttagaaacaatgtggccttgcacataaaggtcaacaagacatcccaagtgcgacttgatgagtacttccatattctcctcaaatttattttattgccttgaccttttctcccagcctcagctgagtgattttcctggtttgttgaatacattttgcagtgatgttatgcttttgtgaagaaggaaccctttggtatgtcagtataaataccaatttaacgtcagagtgattctggagggagttgtgattatgagtttatttatgaaataatgaatattactcattagtctggcactgatgtatttgaagggataggctggattagaaccatggtggtaatagtgctgtcatagcatattttaactgcaggaacattgagagaataattgctggattagaactttggtgttaatagtgctatcatagcatattccaactgcaggagcattgagagaataattacagctactgaatggaacctccagctctcttaactaaagaaacccaaacactttcttaaatactcaatgaatattatgtcattgaaaccattctcccagcaatagcccacaaatactaaacaggatagaaaattatgcctacccaggctgaggaaggtggctgacatctgtaatcccagcactttgaaaggttgaggtgggtggatcacttgagcccaggagtttgagaccagcctggacaacatgacaaaaccctgtctccacaaaaaatagaaaaattagcccgaatggtggtgtgcacctgtagtcccagctactagggaggctgaggtggggggatcaaatgagcccaggaggtagaagctgtagtgagccatgaacaggccacggcaccccaatttgggtgacagatagagtgagactctgtctcaaaaataagagaaaagaaagaaaaaatggctaccaaatatgaatgccctggatctgctaagagaagtgattcacaaccatttgaaacttttgtttctgagtcaacaaaggatgcactaaaataccactactactgccacgaggaactctctgtttttgcagtcatgagcatataatatccccaaacaatatagacaatgtcaccttctcacagggtgtatctctgacctttcagactcagaggaaactctcaaacactcttgaacctgtagaggatggttattctcttcaaagcccatctatctaaaagtatgtcattttgtttgtttgcctatacgttattttcttctcacactagattttaatctccataatatcaataattttgtttttatcatgactattcccagtgcctaaaaaattttttagcataaagctgtgccaataagtagctgctgaattacacagttgctaaatgatacgacacagctagtttggtttatagactcatgggagccctacataaattgcacacctagctcaaaagaatccattattttgagaatccacacaccaaaatgtggagctgggggattattagaggactgaaataagcaagctcaaaaatgagttcttaggtctcaattttaaaagtttgtcttcaggaacctcatcttaattaatttattttttgatggggttttggaattttataatctatatcattaacaattaggtagcaaaaattttacaaatagctgagttattagtatttgaaacaacacatttttcattgcaaaaattccttttcacttgttcagcatctacctgtaaaaagcaaaattacacacatacgctgtaatttcaagggacactctaatattttcacctacataccaatctagcaaaaatgtcttcaaggcaaggacttatgaggctttcctttaagaccaaaaaatgtatgcagatataagaaaaggaattacccagagtaaacacttttggccaggagatttatgaggggaaggatgtctttctctgagggcatatatctcaattttgaccgagctgcgattctctccattagtttacattgctctgtaagcaagcaaactcttctgtttcaagaggacacacaagtgtctgaaagcactaagctgctatacagtgacatcaataatttgcaataaatttaaaaatcatacagtattacagaaaccacaaaatcataaaggattgcagaagagtcattgctgttgggtgtggagtgtagtagaaccaacaaagaaatacttgggccatcttagcatcctataatagtgccccaaatcctggaggggacccacagctctaggaaatgtagtggaaaaaattagagttttgaaagcatatgtgcttgatgttggggaagcagtgatgctaattttaactctactctatttacctgggatatattgggcaacttgaacaaactctgggccttagggtcttcatcattaaaaagcagaaaatacagtagtaacttccttagagattactgaaagaatttaacacctcacaaattccttaaactgtggcagtgcacctgctacaaaacagttctatggtgttgtctctatgttaaaaatgccatagagacacatgaaaaaagaggttaaaattaataatactttcttactaattctcatttaataaattttatattaattcccatattatatgaggcaaaatattttattctttttccattagataaattatgactacatgattccaataaagtctagagaaacacttttatcctgttctcttggctttgaaaggtgtcaagatataaaatttaccctagagggaagaaatgtcaaatatgtagacgctttcattgtgattttttttgtacctcctatattatttacatttcttgtcatttatattttatacataatatatttttaaatgaaatttaaacttgaaaaaattttgattgctactgctgtctgtatttaatcaacaacaaagacacaaaataaaatgagaaactcgtttaacatatatatgttctaggtagttttgaagagctaacatctgatctgatggcagatttctgactcagagattaaaatattattgtgaggagttctactagtgtcaagtttgagttagggtattcagacaaatattaacactgagatcaaattgaaagttggacaaaataataataaagttaaaggcattgaggagtttcgaggcattgaaaatttgtgacctaaaatctgggagaatagggataccaaaagttaaataagccatttggaactcttttagcttagaggtatttgctgttttcaaaaagtttgatagaaatgctgaggagccaaaaacagctatcaacaacatcatggaaacaggccaaaaaaactggagttcaaggaccacaagggaggaagggcacggatcaactcccagcttttctcttgggctctacaaagctacaagccaagagtaagagtgaacattaaacagaccatgcctcacaagactgaagctcagcttagaatcattttgatctctgattggattaaggtgatcagggatcctaagtacccctgcaggaagatagcatcatgtaatgcttcaaaccacttggatagcatttcatatacaatatctagcactaaaaaatgatcagtgatttgaaaagacaagaacatgtggcagaaaataaaagaaagtacagacaatataaataatagagagatggatagataaaggaaatagaaggtgcagattataagtagctgaccaaaaaaaaattagtgaactagaagatgagtcagaacaaattatccagactgatgtatgaaaagacaaaaggatgagacacccagaaaaaaatgatgtatgtcagatacagtgcaaatgattacatatatttgggatcccaggaggacaatgatagtgacaaagaaataataatcgaagggataatggttgataattttctaagattgtttaaagttatcaagccacagatttaaaaagtactagaggtttaggaagaatacattccaaaaaatacgcctaataacaccatgttaaaaagttgaaaagttcagactaagagaagatccttaagagagagagaaaataaaataaaaccgagaccttccaaaaagcaacaataagaaatgaagctaacttctctgcaagattaatgaagacagaagataatgaaatatcttttttttttttctgagacagtctcattctgtttcccaggctggcacaatctcagctcactgcaacctctgcctcccgggttcatgcgattctcctgtctcagcctcctgaatagttgatgagattacaggtgcacaccaccacgcccggctaattttttttttgtatttttagtatagacagggtttcactatgttggccagactggtctcaaactcctgacctcgtgatcctcccgccttggcctcccaaagtgctgggattacaggcatgagccaccgtgcccagccagatgatgaaatatctaaaaattctggaaagctggggaataagaaaccatcaaactaaaaatatcaatatccaagaaaaagatatatgttaataatacattgaaataaatacattttcagccaaacgaaacctgaaagtttgtcatcaacaaaccttcagttgaagaaataaaaacattcttccttcagaaggaaataatctcagattaaaatggaaggtttattaaacaattaatatatatatgtgagtaaattaatattaatttaatgtatttatatatgtattatttcaggacttaaatatatataatatctatttttataatatacagtgcaattgtaataaaggtaattaatatataaaacaacaagaatatagagttaggaaaagctaaagtagttaacatagttaatgtctttgtctcatccctgtggtatgtgtatgtgtttgtgtgtgtgtgtctgtctgtaggtgtgtttaagagtaaacacagtaaaagttaaggatacatgctgtattctttgaaaaatcacaaaagaattgtaaaggaatatatactgatatggtttagctgtatctccacccaaatctcatcttgaactgtagttcccataatccccatatgtcctgggagggcctggtgggaagtaattgaatcatgggggctgttaccgccatgctgttccccataatagtgagtgagttctcatgagatctgcacttctctttgctgctgaaggaaggatgtatttgttttctgttttgccacgattgtaagtttcctgaggccttcccagccatgaggaactgtgagtcaattaaacctctttcctttataaattacccagtcttgggtatgtctttattagcagtgtgagagtgaactaatccatatacctatcaaacagaggggaaagaaaataatttaaaaatatgtattaaattaataaaaaaatcgaacacaataaaacaacaagaagaacattaaaaaggcaggacaaatttaaacaaatattaaggtaatagactaaaatccaaatatttcagaaattacattaaatatgaatggatttcatactcaatgacacatctttccagatcagataaaattaccaaaaaatacaatatgtttgtgaaaaaaacacacatgtaaatataggaatatcaaataaatgaaaagagaaagggtgtaaaaaatatagcatgttaattctaaccaaaaggaagctaatgtagttattttaataactcacaaaataaacttcaaataaacgtggataccagagatgaagagtatttgacagtgtttcatattttactatatattatatagattttattacatatttgtcttagtcttggctgttataacaaaataccataggcttggtggcttatgaactacagaaattaaaattttaagctctggagaatgagacattgaagatcactgtggggtgccagcagattcaggcgctggtgagggcctgcttcctagaatgcctctctctggggtctgttagagttctgatgatctagttacctcccgaaggccccacatcctaataccatcaccttaagggttagaattccagcatatgaatttgggaaatataaatgttcaaggcatagcaatgttatatattttatatattgcatatttagtatatatttatataattttattttataatcaaaagtttaaaatcatcaagatgatgtgacatttttagatttgtgttgacttgttaaagtaactctaaaatgcatgaagaaaaaatgattaaaataaaagtgcagaaaaattcctaattatagtgaaaattttaaatatacattttccagttactattggatcaaggacatcagagattctttaaacattttcaacacatttgataccatttaactgcatttagtacagtgaaatcatccaataaactacaccaggatacttactcttttcaaaacacaaaattattatatgggcacagtgctattaagctagaaattaatgtctaaattaacattggaaatttcctacaaataagacattaagaaattcacttgaaataattcattaaaaagaaatcagtaaaattagagaatattttaattgtattacaaatgctaaaaatgaaataagtgacgcataattaagccacagttacagaggcaataatggtcagaaacatatattttagaaaagacagaggctgaagatctatttttaagtattcatcctaagaaacaagtaaaagaatagttaatacatgcaaaggaggcagaaagaaggaaataataccatagaaaggaaatcagagaaaagtaacctacacagagatgttgaggaaaataagaaaaagaaaagcaataatcaataccgtgaatggtaaaagggcaacatgaggatctagtagatattaaaaatataaaaagattttgaacaaatttatgcaagcaaatttaaacgtttgaatggcatggacaggttcgtagaaaaatatagcttattaaaatcaacacagaaaaatggaaaaatttgaagtgtttattatatattaatgacactgaactcataagcaatgatctaccaaagataaaaattaattccaaaagctaaactacagtttatcaaaatcacttatgaggttagcataaccttggaaatcataagacatctcacccatgaatatagacgaaaattcctacagaaattactaaactgtatctagctatctatgaatataaatttagttttaaatttaggtgtaaatataaattaaaaatataagttataggataaataaatcacaaccaagttgctcctcaacctagaaatttaatttcagcttaactgtaaaaaattaatcacggtaattcactgtattaacaacagaattgaggagaaaaaaatgatcatattaatagatcaagctaacgcattttataaaatagcatctatataaaattaaaaaactgtttgcatacttagaaaataatagctttaatctgattatgtttatctccaatttatctatttcaaacattacatgaaatggtaaagtattgaaagctaatgtgtctgggattgagagggggctaccacctcttctattcaaatttgtactggaggatctctgtagtatgaaatttatgtgatacaagtaatgtgcataataatcgaagagaaaaataaagctcattaacacagggtggattgaaaaaataatttatgtccacagataatgatagttaaaaataagcctctggattcaagatgaacaagcaacgtcaaatgtattcccttatgtgaacaacaagcagctattgaaatgaagttcaaaaagatatagtttacattagcaacaaagtcacatttatgtaaaaataaatgtaacaaaagatgttaaagaacatttgcattatactgcattgtaaaaatattataattaataaactggaggtttacattagatagaaggaaaaccatatttatacatgggaagagcaaatatttcaaatatgtaaattttcttcaaatcaataaattaacataaccataataattgttcaaccatttatgtctttgagcatatgtgtgtgtgtgtgcaagagagagtgagacagagagagaaagaaagcatatgtgcaaaataactgattctacaatttacatgaaatttcaaaaggacaagaatagacaaaacatttttaaggagaacaaagtgagaagacatactctaccaaatatcaagaactattatgaatccacataaataattcagtgtggtaataatataataagtgggaattggaccaatgaaacaaagaagagagactccaaagtcagattcatactggtatgaacactttatttatgataaaactggaactatataatatcaatggaatatatatgtgtatgtatgtatacatacatatatacaaacacacatacacacacacatagttatggtgctgagtcaactagctatcaaaatcgaacaaaaaaagagaaaaaaagaaaacccctacctcataccaaatacaaatattaaatcccagtaaattctagatataaaagtaaaaagcaaaccaataaggcatagatattataggagaatatctttgtgacgttgagaaaggggaatatttgttaaacaatacacacgaaaggccctattaattataaagggaataatgattggtctacaccaacatttgaaatttctttacattaaaagacacgactgggatagtgaaaatgtgaccaagagagtgggagtaaatacctgcaacatatacaacagtcaaataatttgtatttaaaaatatataaataaatcttactaacacaacaatgcaattaaaaatgtgcatttgacatgaatgtatgcatgcatacgccctgatggataagaatgttgttaatggcacaaattatattagcccaaatctagaaaaattctaacatccatcaactgtagaatgtatataagcattcacaaaatcgagtataatatatgcaatgaaataaattgtaactctatgcaacaataaagatatgtatcacaaacgtaaggttgggtggaagtagctgtacacaaataattgcatgtatttaattccatttatatacaggtcagaataggtagggaatcaagatagagggtatctttgggaaggcaactggtgatggagccaaggaagaggcatgaatggagtttctggattgtggacagtcttcattatttttgacttgtggtcatctttgtgaagctacatgtataaatagacctatttggggtgtgttccctggaagcagagcctggttgtgtgtgattcattgagacagagctcttcaaggaaagcagtgaaggaggagagggaaagagaggacactaagaaggatgcagtgttagtcaaaggtgagacttaaataggagttgacttaactcatccaaggtaaggctctggaccataactcacatccccacctgccttcagaaaaggggcagacacttttagccaatgtatatcagttagtagctgagcacacatcctcttcagtgggttgctgctgaggattatagcctctcctcccagctaacccctggtcaattctccagagagggaccagtagctaggactactgttagcactcagatgttaaagcagcggagaatgggtatccccgatggtgaagcatagagcaccaaagcatctatcaatgacatgaaccctgttgttgtggaaattacatattcaaatgttctcagtattaatgccatgggctaaagtcatgaatctcataaaagagcactatccaaagagcaggaacttgctaatcaggtttacttagggatattcctcatccacagcctctccacagtaaaccaaacctccaagcatttttctgaatgcttttttttctgtccaatggttgattttcaagaatgctccatcccgtctttatcatgtggatgcctccttatgagttttattaatttcatcatctctggcatccattgactaatgagtctttccttcatgattttcttttctgctgggtctgcagaggggacaagtgtgcatggatctgttggtatggaaagaagaaagaaggatagcgggggcatctcactatgaatgtattctttcttaaatctttaaaatgcaaaatgcttaatgtctcgaagaaaacctctcatctaggcttgatgggagtcatattctgccattaatgaaacacaaacatccctccttccctcaccttgttacatttaaagagactgaatttgaccaaattactttccctgaaccataaattgcttctctggccacaaacaggaaaggccatctcatttatccacaaaaacatttctttgaactttgaatattctcatctccgatataatgtaatgtgataaatctcacattgagggaggttaaaattatagaaggtatgggggaattaactttccctttagcatggtgggagatgagactaaagaggtgtaataggatgatattattgagtgtcatatttccaaaaacatttattaagcacctaacacttactagacattggaactacagaagtaaatattttctttgagaaagatattggaatggtatattttactcttaatcaatggccatattaagcaagatagtcatgttgttctgtgtgtggttaagatgtacaactccctggataaagtgaaggatagatcggccgggcgcggtggctcacgcctgtaatccagcactttgggaggccgaggcgggcggatcacgaggtcaggagatcgagatcatcccggctaaaacggtgaaaccctgtctctactgaaaatacaaaaaattagccgggcgtagtggcgggcgcctgtagtcccagctacttgggaggctgaggcaggagaatggcgtgaacccgggaggcggagcttgcagtgagccgagatccctccactgcactccagcctgggcgacagagcgagactccgtctcaaaaaaaaaaaaaaaaaaaaaaagtgaaggatagattcagtggtgggatggagaacagaaaatagagaatcattgagcattacactgcataatgcaagtagacagtgatgagaattgaaaggatggtgaaattgcagctgagagagtgatagaatacagacaagcctgggcagggaaattcaatggattttgtgatgaacttaagggaggaagtgagaaggaattaaatgatgactggattgctctcagatttctctccagtgtaacttttggtaatgttgaagggcatgtccgtgaaggtaggcagaagaagagatttaaggaagaagatgcaggatttgatctgtggtaaccagaatttgtgatacttgaagaaaaagatgtttggcatatttaagaattctaaagctctgctgagggaaatccatcaatcacttttttaaatgtattctggaaattacctggtttttaaaaattcgatttaataataaaaatatggttcatataaaatgttttatagttgataactatactgacatctacaaaacttgttattttccagtgctggcaagtaattttactagcttttaatcatgtgaatttgttttaattatcactgtagaaaaagaaaaacgacatccaaagagggtatgcgactgtgtcgagttcaacagaagaatgaggactgcacaattccatctagttcctgtttgaaagctcttttgtccacatgaccatttcccttatggactctccttctacttttgtgggattgtttttctaattagaaaattcattttagcagtattcttatcattccaaaagttaattacccgtgcactgtggcatgagcttcatatctgttgaatttcttcacctttaataaagatcattaaaagggaattagtggcttacttgtaatttctaaaatttttatatacatgagctcaaaacaatcatagatattacctcatattacaggtgaagaaatagagccacaaagaggaatcaaatctaaaacccatattctcactacactatggtattaaattattctctcatgttaaggtcaagacacctattatgtatctcctaactctggctgtcaaataaaaatcagctaatacacgccactgtagtggcaaacaactacccttctataattcattcttaatatagtgacattaagctctaatcacaaaaatcactaaaatcaagtcagcttccagtttatcacaagggaacataatttcgtcatattattcagtaggccttttttgatactctcgcacacacgtgacacacatgtgagtgtgcacacacacagacactaaaagaaatatagttcttaatatctcttctaagtagccctcaatgatacagtacacacatttaaagtaaaagaaataaagttagaaaatgcaaacaatacagaaaaatgcaaaattgcaagggaaattatttaatctacctcatacctaagacctctttccaaatctaaacactgacaatagatttttccattacttctttcataagcacatatccatatttatataaataggcatttgtttatatacttatatatgttcacacacatttattgtctgtttagtaaacattattatactatgcacacttgttttcctcacttaatgtcagatcttaaaagatatgtttctaacatatatattatgtttgtctttgggtcagcataattacagacatagatttagagctgcccaatccagtcatattcagtatcacattgtctttaaaacagaatagattttctagttaagtgatttttaacattcacacattttcaggaaaacatggttagttgtttttaaatatatcttctccctttctaagattaaaacctgctggcccgagtaatttgaacacatcaccaagaaataattcaatataatttttccaaaaaccaaaaagtatcatcactgcaaatatagtatttatttatttttttagaaggagtctcaggctggaatgcagtggggcgatctcggctcactgcaaactccgccttccgggttctagcgattctcctgcctcagcctcccaagtagctgggactacaggcatgtggcaccatgcccagtcattttgtatttttagtagagatggggtttcaccatgttggccaggatggtctcgttctcttgaccttctgatccgcccacctctaccccccaaagtactgggattacaggtgagagccaccgtgccctgccaaaattactgtttttaaacatctataattagtatttctactctttaatcatttttaattttacattctgtatttgtgcttttttctgtattccaggaaattttgctattgtcccatagatttcactgttatccatgcaaggactacattaagtggaaggattctaaacattacctttgagcacaatatgttgataaattttaataggtttaaataatccatgttgagtagctgtatatatctttggttgcatcactgattatttaagacaaattctttgaagtgggattattgagtcaggaaaatgaatcccaatgttaagacacatcagagactttgatgtaggggtatagacagtactgatgtttttcttgttgaacaagttcctctctatgaataatgcacaaaccactgcttgccaagtagaaaaagtgaaatgccactgggaaatgaaatacatgggtagactgaaaagaggaagtttttgagatgtgttagtggaggataataacttaaaattaaacatctatttaaaacagaaactttgatggtatcgtgtggaattctgcccaagggaaaggaagagtaaaggagaagctggacatgcacaatattgctatgagcagaaaccctaaaaatggtctggggtgtgaggcagattgagtagacaatcctagtacatgctatgggttaaatgtttgtgcccctgccctgcctaaaaatgttcttatgttgaagccctcatccccaaggtgatattatttgaaggtgtggtctttgggaggcgattcggttttcatgaggtcatgggtgtggggcatccatgatagggttggtgccctttaagaagatttctgtatccctcagcccatctccccactggccaccatgtgaggacataagaagaaagaggccataggtaagccaggaagagaggcttcaccaagaatgggaccaggctagcacctggatcttggacttccagcctccagaattgtaaacaattgttgttttagccacccaacctgtagtattctgttacggcagcctgacagtatgtaagctgggagcaggatacactggacaatatggtgggagagaagatactcatctcaatctcatgagttgtgctgggcttcggcaatgcaacagggagaagctccaggagacaggctgccctgaaaagacagatgagtgcacatgactccatcagcggaggacacccagaactcgctaatgccctcttagaaaatgccgtggagggagttcaaatgaagctgcaggatttggctgtaggatcctgagattatgtgaaatatattatgacagtttacactgcagggcttgctagaagtggatatttccactgaatttgaacagtttgctgaacagaacataaagaagatttggccccagagggttgaagcctgccaaggagggaagaaaaaagaaaagagagacatagcagcgaaggctgagctgaaagcagcatccctgtcttcctccttttcttacactccaaggacagcaccaactgaccagctgtgtcatcccagcagcttctaaagtgttctcctctctctatttttataagaatcacacaatgcacagcactacccaggccatgattgctcccagctctccccacaatgattcctccatccaatgggcaccacgtaggtgtagcttatcttagtcactttgggcagcttgaacaacagacatttatttctcacagttctggaggctggaaattcatcaaggcaccagctgatctagtgttggataacggcccacttcatgattttcagacaatgcttcttgctgtttcctcacatggcagagacagacgcagagagaaagtgagctgttgtgtctcttcttataagggcacttgtcccaggcatgagggctctgccctgttgtcctaatcatctcttgaaggacccacatttcttcacattggggattaggatttcaacatataaaacaaacattcactccataacacagcctctgctcaatttgaccaatgttctttttttctgtttgcaaatggaagggttgcattttttcatgaagatttatcataaggacatgcacaataagagaaataatttggagggtggtttcttgtactgctgtatgtgaataagtaagtgttgaaggatactcttgtaggtctctccttttgtgctggtaagaccttggcatactgtcttcctaggctctacacagatgatgtggacattaaatatgcttagtttcctccttgcccccttgggctcaatctgtccatttaagaaaaaatgaatgggtaacgtatcatgagcgctacaatttcttgaatttagaaaggtatgcaaagacaagtaagaaaaacgcaacactctactgttttaaaactattttgtgaattttggaggactaatacagccagaaattaaggtgtaaaaataagagatgtgaaaacctttgacaaaataagaagtagaaattagaaatgcaaaaaaaaaatactttcatatcactggttttttccattaaaatacaatttttccattgtgggatattttaatcaaaattacaccagggaactgaaatgaaaccattagactgtagtgagtttatttatctaaccaggggatcacaccagtttcaaagcaattttgttgcattttcatttcttgctgtgtcatgtcgcatatcagagatgcaattgaaaatgaaattatctgtaaccatgtcaccttaatagtatttatttaaaatgcaagtgttcttctctggcactttattaattctaagaatacagtatggtaattttaactaaggactatgcataaaattaaattttaagatgggctgaaaatccagttggcaagtaatgggatttgtgagtatgcatgtgtaacgagtagcacacatagacacactgcacccaggagagggagaattctgaaataaaggatgcttagttcattttgctctctcaaaacagcacactctgactgaatgggccagagtgggtccatttgcctcatttacctatatggaaaaaaaatctgaagggttcctttaacatgtaagaaactaacagctggggttctcaggagtgaataatcttacactgggatgttaacaatattcattttattaaaccattaccttgagcaaaatatttacatcaaactacaaagaacacggagtcagaatttttttttagaaaaaatcaggtacagttcctcatcactgcttctcagctggacagaatctctctccaggatggctgtgggcagaggctcatccacactgcggattctctttacttgagcatgttttactttctgcagcttcttatctcaatgtcccatattgttgtcatgtacacaagtctgctcaaggttcctgtgtatgtgttggggagtaggtgtgtgcctgtgtttgtgtgtgcatgcctgcatgtgtctctttgtgaatgggtgtgtctgtatgtatatgtatgcctggacgtgtctaggtgtgtgtctgtgtgggtgcatgtatatatgtatgtctgggtatttgtgtgtatgtatatatgtgtgtttgtgtgtaagggtgtgtttctctgtgtttatgtgtgtgtgcatgtgtgtctgggtgtcgggggtgtgggaaggtggatgtggatgtgcgtttgtctctgctgaaaattttaatccacttattacataaggacttgtccaatgctcattttagttatcatctttctaagttcatacccggagatttttgtttacagtaaattacctcagcaaaatgcttccaatttatattaattctcacttctgtttatttgcacctgtaaattttctaatgaaataatttggagctctagttttatgtgcgtgtttctgtgtctgtgtgctgataggaaagatattttatttcgaattggaatatgagcaaaaaagggattcccagaggcctggagccccagtgctgaggcacctgctttgtacaatcccattacacagctatctggcctcagggaggctgggactggtccaacctaatcatcctgccctcagtcttacatgcactacaatatgcttctcctgcttctttgtcatttgaaaactgtagtgagggttttggcttaagtgaccctgcctgacacacaagtgatggcattaaatatactttggactgtgttatgtaggaaacccttatccaccacatctaaaaactttgaagtcctaaaaagctcatatagcaaagccaaaaagtgctatatttactcattttaaatttttaaatggccaattactttatataataataacattatggaagctggaaaagaaaatggtattaaaagagtgagagaggctgggcgcagtggctcacacctgtaatcccagcactttggaaggccgaggagggtggatcacaaggtcaggagatcagaccatcctgactaacacggtgaaaccccacctctactaaaattacaaaaaaaaaaaaaatatatccaggtgtggtagcgggcgcctgtagtcccagctactcgggaggctgaggcaggagaatggcgtgaacctgggaggtggagcttgcagtgagccaagatcatgccagtgcactctggcctggtgacagagcgagactccgtctcaaaaaaaaaaaaaaaaaaaaaaaggaatgagagagaatggggggaaaggaaaagagtgagagacctcaattttataacaagaacaaaaattcttagtagcaaaaactagaaaagatagctcaaaaataaaagattattcctacctaaaatctccatgtgaaaataccatatgagaaaaaggaaaacagaagaatacccgtggcgagcagccttgaagaaggtccttaatgactccacctccttaatgaccccacttcctggcaaatggccaattattccatatcatagtaacattatggaagctaaaaaagaaagatattaaaagagagtgtgaactgaattcagtgactcacttatgaatagaacacgctggaagtgatgagatgttgctttcatgatgaggttacaaaatacccaggcttctgcctcaggaggcctctgtcttgcatgcatgagtggatggtggcggttgccatgtggggaggcccatgtggcatgccttgggaggcccatgttgggggaactgggacagccatctaggaaccgaatcctgctgaaaattacttgagtgaggtcagaagcagatgttcccccattccagttttcagatgatcctgcagcccctgttgaaaccttgactgtaggtttgcaagagaccttgagcagaggcacccagctcatagaactcccgggttcctgactgacctacagaaactgtggattaaatgctttttgttataaggaacaaagtttttgggtaatttgttatgcagcaagagaacattaatacagtacattatccttcatgctctaatttatctaataaattcaaggacttggaaaattcatcaatttattcactgaacaaggcaaattgtgtagcgtgtaccatacgctatgtgaaagtgagataagacggtccctccctcagaggccttatgttgtaatgggaaagacgacctacaaggactttttgggaaacttcttcctgacttgacctcacccaatctggcttgattccacttcccaaaatgcaaactgggtcccttcccactttatctctcaaacatgggtgctctctgtgtgatgtatctaacttcccaatgtgggattgggttttaggttttgaaatccagggtcaagacttcagagacaaagggtctattcctggtcctgagatgctgtgaagccacatggccaagcaggattttcagctacaaagtgtcaggtttgcttggtatccattgagaactctgaaaggattaatgagaataatgtgaagactcacaacatgattcagaagaaaaatgcagcatgacaagtattcttatgttcaaaggtaacctattttttcttaaaatataccacagggacataaacttttgaaaaaagtgtatttttgatcttttttttttttttactgtaatgagactggtgaacagctagcaaaaatccaggatacataactttttcatcatgatgccatggtgtctcaagccctattcaaaactcatctccatcacacattgagctaatgatttggggccagtcttttgacctaaacgtttgagccttagtttccgcatctgtgaagtagacatagtaatccctgccatgtcacaccacagggtttttcagtggcccccagcacttggcaccagagcacctcctccacaaacagatgagggatgctgtggaccaggaaggtgtgggaaccaagcttgacaagcagcttaaagtctgttgggaatctcttgctttagagcacacattactgcagaatttgctttctagcctgtgtacaatatagttagtacagctatttccctactttggggaaaaaattggtatcttaagaagatgtgtgataaccccaagtcaccctaaatctcagtgcagcagcacatgggcacctgctcattttgctctgtcaaagtccagtgaacactgccaagtgtactgggcagctctttgtagttgccagccacgctgtccagcctccttccacttcacatgcctctgtgtcaacatatttctctagcagggataaatcaagttaataaggtgagtaccaggattaaatgcttctatatagaagggagacacatcacttctgctcctgtttcattggccaaagcaggtctcatgtctactcaacatcaagtaaatgagcagaaggtccaagaattagtgacggactgaatttggtcagtgaaagaaatgcccaccacatgcatctggatcctccccccttcctctgaaatctctgtatgaaggttcaagcagagttcattaccaaaacaaatgcaatcagatttatggccaaacaggatatccagacctggtttctccttaacacataaagcatttgctgctggtatgaaagtgcctgtcctactcacctccctttgtttagaccccactgcctttgcatccatttctagtccctcctagaatgctctttatgctccccaggagtcacaatggaccgttaagccaaagcggagaagatgtgctgtccttgcctctcaccgttgaagcctgggatggggagtcttcacatccttagactggggtaccttctgaacaaaaactcaccagaatgccagaaccactctgtactatgatgcagacatctccttgttggggagtaaggatggaaagaaaagcacaaaggaagagcaaaaggaaccatctatgtgccctggcattcactttaagggaaaataaggtataagtgaatgcatttcctcaaatttcatttatcattttatatgttaatatgattgttagttgaacaaggtcactctgtctgtgagcaaagtaccataatgaatcctggtaaaacagtgaggttgacactatcccatgccctctggctcttgcttggggctctccaactgcattttaaaacttctataaaatcctacttatagatgccctcctgtagcttttccatgcactggaccttgtactggttagactcatcagggttcagtgagggacccatgcagaaatacctcggcaatgggcagatatatagacgtgaagaaatgtctttcagctatagtaactccaagactgaaatttacagcaagtcttacacaaaacaaggtcagtaactctgcatcttcggtatatagtgtggttactagacctctcctgtctttggttactcaccatttaaactccctcagacattagattaataaatagatcaaaattgatatcagtaaggaaactatagagctccagcaaagttctatatgacaaaaggaaacatataggataaaaaggaaaagtgattaataaatgtattaaaatttaaacctgctaatattcaaataattaaaactataaccacagcatacatgtttatcaaaatggcattttcttttttttttttcctttctttctttctttctttttttttttttgagacagagtcttgcttaatctgtcacccagcctggagtgtagtgacacgatctcagctcactgcaacctctgccttatgggttcaagcaattctccacctcagcctcccaagtcgctgagattacaggcatgtgccatcatgcctggctaatttttgtatttttagtggagacggggttttgcatgttggccaggctggttttgaattcctgacctcaagcaattcacccaccttggcctcccaagctgctaggattacaggcatgagcctccatgcccagccgcaaaatagtcattagtagctcagatgggagagggtaagggttaaattagagtagtaacctttgtctgagtcacacgcattgtgtaagagagagaagagtaaagctcctcttgtatgtgtatgagacgaggtcacagaggtcctgtgaataaaatcttccgaagtccctccctcatggagtgtcctggttgtgtagtgggaggggcaccatgattgagtcccttgttggctaactcctagagccattggtctctaaccatatttcactagactgtaaattctactccaggacatacattgatcttataaatttggcattccctgtgcataattcagagtctgccacatagtagggatgtctgtgaataccaatggagaagtttattatcttcacaagcagtgtgattcttcatgaggcccaaaatctgcctacatggaggtgaaatgtaaatttctgtaattagtgttaaccagtctgggacacatgttgttgccacaatgtctaccacaggctgccctcaccctctttctcccttggctgtcctcctctgtgaaggtgagcaaagccagacagcaatctccttgcaactgatgaggagagatgaggcaaatgattggcaagggagtcttctggggtggagcggagtttggagttcctccaaagattctttcttgcaaaaaaaaaaaagcagcagcagcccagggaagaacacttctgtcctgcactcttcctagtctcctgtctttgaatgtgattgtggacatgaagcccaaatttatggaaagacttggtaatcataaatgctcatatcacctaaatgccaacccagagcacaggccatcaaacagcagcagctaccttctcatagatgtcttgctataggagagcagtaatgccatttttgatcaggcattctgatacttgtaaataaagcattccttattggtgtcatatcccacatatttataccatttactcctctgctgggcttgggaaatggaaaaccattcatctgtttcttcttcttcttcttcttttttttttttttttgagaaggagtctcactctgtcgcccaggctggactgcagtgctacgatctcagctcactgcaacctctacctcccaggttcaagcgattctcctgcatcagcctcccgagtaactgggattacaggtgcccaccaccacgcctggctaatttattttttatttatttatttatttattttttaagatggagtctcactctgtcaccaggctggagtgcagtggcatgatctcggctcactgaaacctccgcttcccgtattcatgccattctcctgcctcagcctccaagtagctgggactacaggcatgcaccaccacgcccagctcatttttgtattttagtagagacatggtttcaccatattgagcaggatggtcttgatctcttgaccttgtgatccacccttctcagcctcccaaagtgctgggattacaggtatgagccactgtgcctggcccctctgtttcttttaacactttatttaaatgctgtgaactctcagttcaaaatgctttagtacaggggtccccagttcctgggacacagaccagtactgcttaagaaccaggccacacaggtgagtggctggtgagtgagcattatcgcttgagctctacctcctgtcagatcagtggcagcattagattcccataggagcaggaaccctattgtgaactgtgcatgcgagggatctaggttgcctgagccttatgagaatctaatgcctgatgatatgaagtggaacagtttcatcccaaactactcccctaccctgtccatggaaaaatcatcttccatgaaactggtccttggtgccagaaagtttggcaactgctactttagtagaaccagaataagacatatcagttcatttttgcttctactcacctgacatttgtttattgaatacatgcttcttacccagctctatgctaagagctactttacttagccttcctaacaagctttacttagccttcctaacaggctaagtaaagtagctcttagcatagagcttggtaaatagcatgtgctcaataaacttgtccattcttctaatacatttatgtcctctgtacatcaatggatctgaatgcacatagtatttctcttgttagtgtcatacaagtagtagcctgaattcaagaagtctcatgagagacatcatttgccgtagacaggcttagcatacttagccttcccttttttttttttttttttttttaaagacggagtcttgctctgttgccaggtggagtgcagtggtgcaatctcagctcattgcaacctctgcctcccgggttcaagcgattctcctgcctcagcttcctgagtagctgagactataggtgcccacacccagctaatttttgtatttttagtaaagatggggtttcactatgttggccaggatggtctcaatctcttgacctcatgatccacccacctcggcctcccaaagtgctgggattacagggatgagccaccgcgtacccttcttaacaggctaagtaaagtagctcttagcatagagcctggtaaatagcatgtactcaataaacttttccattcttctaatacgttttgtcctctgtcacatcaatggatctgaataaacacagtatttctcttgttagtgtcacatagatagcagcctgaattcaagaagcctcatgagagacatcatttgtcacagagaggctgactgtggaggcaggtgtcccctgtgaggatttcaaaagcactaggaatgacggatgaattttccaactttgctgtgattttactgacaagtgaattttcaaaggcttgtctggtatctgctttgcagattttccctttgcttttttattttttatttatttattatttttttgggggggttaatacttttaattacatgattgtaattatacaatttccactattcgatgttttgtataaaaccagttacaacccacaagattttcaaacgtgacaatatgtatcaaactacacacatacgcaaagtttacaggccattaggaagctttatcttaaaaataccttcaggaaaataaacattcattcaaccagttctcttggctttaaaaaatatgattagaaatatacactgtaaaaaataatcaagacaatgattgatcaatactgatcagttacattttaaaacttttaatctgtacatgagtgcaggttagataaaagtctgcaaattgttaatagaaaactgcagtactatcaccggatgaacatgtctgttgacaattttaccaggtaattaaggaggtaatttcctacacggtataggtgaattgtccagtctttaaacacatccggagtcatctctactcagtgacgaggagaataccctgatgtggggaaatggaagaacagcagctagcctctccagggcagtgtcagcgggagagaacatttaaaggaacaataaaataggtcttaaaagttgcttgtgatgagcactgctttccaaaatgcaataatgatttttttttaaatgtagaaagagaagctatgttaacaacagacatccaatgagtgcactgcttctgtggctcagatggtgactgggaaaagggagggctccaggagagccctcaggccatgcacaagcccaggacatccggcccagccccagcgagcacactggcctcgagcacactggcctcatgacaatgcttgggaactcctctaaaacttgcctaggcccaagaaaagagagaggtagcaatcacccctgtgagagggctagaggggaggggaggaagtaggtaggggacaggctaggggcatcaaggtcagaacggggaaatcctggaggccggcagacccgcgtgctgccgggaagcactggccacgccaggccattctgctctcatgaggagctgctctccaccaagttctacaaaaagccacgtccgtccctacttccaggaacccagttttgcagatactcttcctccagactgtcattgactcttgataattttgagtccccagaaagcttcaagggcacctaaaaatattcacttctaattttaattccatcgcaaactgtcccggtgtactttcagggctatttaaggctcttaagggaatctatctgacagacacagtttcatgttccatagcaacaaggtcttctataacaaggactctaatcccagaagattctgggtgtttgtggttttagttgggggtgaggggaagagtccactctcattcatagcaggaagaactttccatccctcagacccagagacttcttggattctagagatggtccccataagtctagagacggtccccgtaagtgtaacactgttgctatgcacaccatcccaagtcatttgattattacaaggaatgtttcttcaccaaatcacaaattttctatgactaatttcagtgagccagttaaacagaaggatttttagaaagagtcacagtgatagcaattctaggtggaaacttgagcaggcaacatgaagaggcagtttataaaatgaaaaaggactgttgttccgccaacacccttccttttctcagacaaaacaccaggaggcttgttcaccgtgagggagacagtactcacaaaagctgtggcacccacatttacttgttctgatgggatgaaaagccaaactaagaaggaatcagatggaagcacaattttcacaactacctggattactatttatgaaggggatggccttaaaacgggtaaggggaagaagtggtgccctgagaattcaatgctttatgcatggcacagtttaaatatttatattgtctcagcttaaaatagcaaaagtaatgttcctcctcccaccaaaatcttattgaagagtggtcttcccacagccaagtgggtctttgtgcctattcatttccagggacagaaaaccactgtttttctgtgatccagtccccagtgtttaaaagctagcctgaccccaccacatagtgcttggcagggaaagagtcacttgtttggctgagaatacggcatcttccgtctctcgtgatgccggtcagtttcatgctttcttccaagaaagtacaccaaaatggaggcactgcctttcaattaccttttgcattaaagactttaacttgtttattccaactgctttgatttcttacagttttgtgaaaaaggcagcttcttaaaatggagttgcctcctgatctggcgcacgccttgtgacttaggagggcatttgtttcccactgcctgtcaacatctcagccctccatgctcccagcacaggcaaaaatgggtttacaatcattaaaccacccacctcttatggaaggaactgaggtgagtactaaatattcttttattttgggccccatttttttttttttttagcagcaaaacaattctgtttctctaatttcttcatggcacagactctgctgtgttccagtagggttgcgggagaaggcactctgcagagttactagttgtgttccctagccaaaggcagcagtgagattcagaagcagatcattgttactgagatcacaggccttatcaatggccttaggctgatctcataaggaaaaaaaaatccaatgttacagagaaggactctaaaaaagcggtaacttttttttttaaagccgacattatttgagattgctgtttccaaggcgaaaaaccaatagtgtgttttttccatgcatggaaggaaatatgattttaatttgtatgactggcaaccaaacaatgggcaacctcccagttcttcagtccctaaaggacagaaaaaggaatgacttgcaacatcttccaactctgaagtcagtttctcctcctgagtcttctaaagctaccattaatattctcttgcaagttttaggttaccaaggtatcacctgatattacaacatgcaacagtgtttaaatgtggttttcacagattcttgttaataaagcactctttggtggaagacaagcagcttgggtacttatcagagttaatattactacagtattacaaacagtcaagtgaagatgataaagccaaatagtatcaaattacagaaagtaccatttcagtaatgccttttgtatctttacaaattttgacacagggtcgcaagctgaacagaaaataaatacataaaaaacctccatcagatcctcaattcttctgaaggccagcaactacaatgcttgccatcacaaggacacacatgcaccacagaccagccagctccctgggtaccagagggcttgggtatttacacctgagactaaatttacaacagcatttttgtcattcagcttgagagctgggcctttctttgagtcattctttttgggagcaagcccccaaaatccagccataaactggccccaaaactggccataaacaaaatctctgcagcactgtaacatgttcataatggccctaatgcccacgctggaagggtgtgggtttaccggaatgagggcaaggaacacctggcccacccagcccagagtggaaaactgcttaaaggcattcttaagccacaaacaatagcatgagcgatctgtgccttaaggacgtgctcctgccgcagttaactagcccaacctatgcctttaattaggcccatcccttcgtttcccataagggatacttttagtttatttaatatctatagaaacaatgctaatgactggtttgctgttaatcaatatgtgggtaaatctctgttcgggtctctcagctctgaaggctgtgagacccctgatttcccactttacacctctgtatttctgtgtgtgtgtctttaattcctctagcaccactgggttagggtctccctgactgagctggtcttggtacatttgcttgcacccaaactcaaaagttcattactgaaaccccagtggacattttctccattgattagcttcttaggtggaaagcaactaagtcttttgcaattttgttttgttttcaaattgtgctaatttctgttgcagttttcagttcctagagtcttccttcagttctggtcacaggtttttacttaatgcaaaacagttttagtccttgaaatggagagaagcagctatctgtcagggggtcctgatggctactatgttctgaaatcttcgagtcaggatagcaggatgggaagaatgtagtcacaaacaatccaccagatgacaacactacacagtgtaaaggtcagcacagccaggggagatgggagaagaatatcgtttgtttttgattgtctttgccttttcagggcccgacttctatcaccttgtgtcactccattgatttcgtcgtcatcaccgtaaggtttgggttcttgctggtcttgattctcgaccccatttatggaaatgtcatcaacaccagagagaagtttggagaaggctgctctgtgttgtccattctcctgcccctttaacttctgacgaaaatagtccccttccagccagaggcttgtttgcttcatcaccaaaaactgctgcggaggcccgatcaccaagccaggtctgcagatccttacccacgcaatggtctcggctgctgtcatcctgtaatgcttcatgatgtagcaggctatcagagtgcctgtgcgaccaaggccagctttacaatgtactgcaatggcaccctcagcattttcacagatatccagaaatcttttgacaatggcatcagtaggggtgctgccatctgcaaagaaaagatcatggtgatcgaagccagcatccgtaaagcgtttggcatcatgtatccttttattcagacgaataatggtagtaacattgtgattcttaaaatattgaatataagtctcgggagaatgttggtggtaaccactttcaagtctggctcttgaatgaggtccacagaaggcaataaatcggtctggtattagccaatttaaatctccgttttctgctttttcatagtgttcatattcatcaaggttaaatgagttgaaattaaggaagccatactgcattgccttctttactgcatgaaaacaggacacaggaaggggaacgtcacactctggggactgttgtggggtggagggaggggggagagagagcactgggagatatacctaatgctagatgacaagttagtgggtgcagcgcaccagcatggcacatgtatacatatgtaactaacctgcacaatgtgcacatgtaccctaaaacttaaagtataataataaaagaaaaaaatatttaaaaaaagaaaaagaaaataaaaagaagtgtaatgtacaaattgcagcttccataggcagcatctctgaaaggaatataggatgtatctccaaagattaatattctatatgctgcttctggggttctccccaagtatataaccatgtagcatccaacaaggaaggcagcatttgcttgttttctctgatcagagccagtaaaatgaacaattttcttccttaacattgtaatggactttaatttcttatttatcttgcaacaatatctgtaaaccatttgccagattgagtggtccaaagtcttcggagaagttctcatattcgagttcattatctatgctgaaataatgtacatttgatgcactctttggtctgctgtagagaatggcaaaacgaaggcgatcggtgatgtccaggtacacgtcgtcctgggggtcccagcggcgcgggtcctgcagcgtggagctgcgcatcttcttcacaccctgcaaggtcaaagagcagcgctgccagcagaggggcgcggcggcccagctcgaccgccgcttgcttttccgcttcctggaggcggccgcagccggtcagggagcaacgaccacggccccgcgcgcgcccgccgaggctcgcgccagcgccgcgcgggctctcaggacggcgggcacagagcggccttgcggggatggccggagccagcggagcccggaaggaggaggtggtgcaggagccagaggaggggcctggcccacagcgcctgccccgctccctcccgcaaccgccctccctttgcttttttaaaccatgaactgaagggctatatcatactgacatcaacaaagtgttagatgaataagtcatcatgctcttgtcatagcaaccacctggatcttaaccttctctccagtctctggaaattcagccaaataagtgttacttcgagtatgactttattaccaaatgacagtatttttgaagcactcatttaggatccattaaaagttggaggttttgaccatttgatattgaaagtcatgcctgcttggagacaagttaatgttgacatattgctttttcaccaactctcccaataccccaaccttggaaacatgggagcacaagatagttaaatagatagtttaaaagatggcatttcttttttctgttctatgtgggctttccaaagaaaagtcttggagaagctaaacaatgtgtgtagaagatcacacagggatatcacaagtgataaattttatacccagtgtcatcccaaagccaatatgcagcttcgcactcctcggcaacggaacaggcctctctccttcacaaaagagagcttcgtgaagcttcatccctaagttttgggttgggggtaaaataaagaagaggactgatgggttgttcttgagcttactactcattcatacatcttcttgccctttctgtttggtgggatttcccctaatcatttatatccttctggtgtccacaaggagacctaaattcccaattagataggctttatgaaattttaaaagtaaatgtatatattagaattagtttaggagaaaggagagaagagtaaaagaagataggtaaagattcatatttgtccttaaagattcaagcttctggatgccacaaatattttgattaatggggacctcaagaataattttgctcaccactgtcccaatgcttgccccccatccacaatatttctgtccagtgaatgcattgtattttcttttctccagtttctgttggaatacccgtatctgataggaaacacacgtctgaaggcatgcagtgaggatgttgatttcccttgccttttcttatcatttattaatagattcagaaacaatttactgaatgtttgctctttgctagagacctggttcttgctaagaaatgcaacctttcatatgagacagtcttgctcttggaatttgcttgtatagtcaccacactatccatgaacacttagacccctgtttataataattttaaaaatcctaaagacaactgattagaaaagtcacttcatccaggttgggccactcagatcccttcttctatgaggtaaacttgagtcccagagcccctccttattctctttggggtccccgagtgaaatgctcatgtaaaatttaatctgggtagccatatctgaaataagtgaaaggtaggctgagaaggccatgcttctaagaaaaagtaataaagcagactcctagagagaaacaacaatgattgaccacgtggcaccagagacgatggagactgttatctaccctttcagcctgaggtggtttccctctagttattggcatctgcttctcaagagatcttctccttaagttccggagatactatcttattcttccttccccagtcctcctgcaattgtctggctagtctgagagtgtttgtatctacaactcaatgatttctgcctaggtctttgttattcaggtagccacaggaatagactcttttgacacatctgaaaagatatgtccatggccgcttctctgtgggaggaaagtaaagggctctacttttctcagagaggttatttatttttcattgttgaatcccttttgctccttctacctttactgttgaactccaatgtgtgtggagggtgttgggcatggagaaagttttattttctcacccatattagctaccattttgaccaccatttctgcataagttgggatatacagacaactagaggaaggtttaaagagcagtctactaattgcctccaagatcatctaaactttacagagtcaaggctgtgtggaaaagtaagctattctgtaatgttggatcaaacaaaaggggagattctcactggtcatgcttattgaaaacaaaacccaacaaatgaggataactaaattacaatgaccaaacagggttgtcatgatgccacagttactcgcctgaaattcctgtacctttttacttataagaattccaggagctggtttcatcacaaactgataatgactattccaagaagtgctgtagcctttagccaatcatctgttagctcctttctgttgaccaatggtatttctggatgaacaggctgagaccaccttggtatacctcttcgttttgtccttaaaaatctgcttgtaaactccccagctgaaagcacttctctgacgtagtttgcatatgtgtttcccgggttacactcctcaaatttggccaaaacaaattctttacttatgctaattttgccttagacttttatttcagatcaacattatggatgccttagatggatgtgttttaggtgacccagttgttcaatgggtcgcctccattctttatctctttctaaaacctcttattcttcccttagtcttattcttttaagtctttcccccatcctaaattctagtcctcattttttgtctattttagttactcttccctaaatacatatccaatcccgaatctcctctgaattttatggtgagattattatccccagctcctcacagctgcttgtttatgctcctggggaaagagaaactatggcatcagtcatggagtcacctctgcagcctggctttctcccttccctttcgtttgagctccagctataagctcgttcccagaagctatacttgctttggcgcttatactcattctgttccctctatgtaaagtaaatattctcctacatttcctaactttgtagcttataatcctctgtccaaacttggtggttcccagagtacttgcatcttatttgattgtttggtcactgcacctgagaatttgccgtgtgtaattctgcataaagaaatactgtatggtaatatattcaacataccatctcacatgcttacctgatacatctgcttgtatggctgtgaagtttaaataacttaaaatacaaaaaaattagggctattggatttgggaaatacaagagttgtaaaatgactaattaaataatacaacagtaaatgattttatggcttctagttatttttcaagctggaaattatttggcatataagaaaatgcaagaattcaagcaagatatttgtcataaaataaaatgattaaggtggggatttcatgtggttctttcatttgctcctcttgcgttagaacaattcaggaggtttgtgcttatgagccgtttatgacacttaattcgtctttaaattaaggcatattttcactccaggattgtttttcccctccatataaaaataaaagacaagctttgtaaggcctatgaacagtttaactaagttgcttgcccttcatgccagtgacaagtaatgagtaagaactagtaggtgtcattgagaaaacagacattgtcactccagtgtcaatcaaaattatctggtagtgaaaactggactttaaattttaaaaataacgtgagagctgctagaaaaattatgaagaattgagtagggtcacagcactcgacaaatcttccaatttctctgccactggcttagtgtcacctgtacattttctagtctaaaagaatgtaatagcccaacagggtcagcagcgatatgcacctctcccaaatacatttctgtttacattcctgaggtccaattatgataacaatgacataatatgaattctaaacacatttgtattgttgatatagtaagaaatttttcaactaattagaaaactctaccttttaaaactgcacagttaataaatataacacatacgcatgtgctgctgtttctgcttttgttttttgttttagctaagagctaagtctatgactactacttcaggaatgtttgtcaatttaatatgagctgaggaccatcgcacttctagccttcaagcttgtattctatcaggaagaagggatagagaagaattggtagaaaacattgtatatctttgccgggcacatgtttgtagtcccagctatctgagagactgaggtagaagaatcacttcagcccaggaattcaagaccatcctgggcaacatagtgagaccttgtctttaaaaataaataaatacaaataagttttaaaataaaataaaacaaaatatgtgttttttaaaaaattgtatgaactcaacatatggctaattttcttcatttgtttcattattaatgaaattaaggaaatacaaatattcattttaatacagatttattacgtagaagtgtttgaacatctttacactatttactcttttatcacaaacccttcattgctttttattcttggcaccattcttaggaaaatggagaccacagcaccagcttctccctgcaaatccccatttgtgcttgagcagccaagtggttcacacttcttgccacattcagaagaaacttcattcattatgccagaaataactgagaaataatgagaatgtttcctataaagtctaaaaatcatactaaagaggggatccatttatactgctgttaggaattgaattgtgttcctccttccagatttctgtgttgcagtcttgatcctcagaacttcagaatgtgactgtatgagaataccggagtaggttgggcccatcatcttatatgacttgggtccccatacaaaaaggaaatttggatatctcaacctgaatgaaaaaaagataatcaatatataccaactttaaggtgaaccaaatgttaaaattatctaacaaagattttaaggcaggtgaattgaaaatgctccaacaaacaaccaaccacagatgaaaaatattaaaaattaataaacagcaatacgataaaaataatacaaataagaaaccagtatagtataacaactatttacattgtattaggtattctaagtaacctagagatgatttaaagtatacaggaagatgtgcataagttatatgcaaatactacaccatttttttgtcagaatcttgagcatcctcatatgttgatattcaagaggggtcctggaaccaatcaatcacccatggatacagaggaatgactgtacacagcaaaaaaaacaaaacaaaacaaaaactagaaagcgtcagcaaagaattaaacaattcagcaaagacacaaaaacataaagactttgagagaaaagaggagaccagttgggcacagctgctgtaatgtgataaacagctttgaaaaactaggtaattttacttttttatttgtggttacattagtttgctagggacaatcactttaatcatttttctcctgagtatgatgtccacctgtatttctaaaacaattggcttatgtcataatttcttgtttttcagatttttgttttgttttgttttttgagatgcagtctttctctgtcgctcaggctggagtgcaattgaatgatctcggctcactgcaacctccgcctcctgggttcaagcaattctcctgcctcagcctcccgagtagctgagattaccggcacctgccaccatgcccaattaatgtttgtatttttagtagagacagggttttgccatgttggtcaggctggtctcgaactcctcacctcaggtgatccacccacctcagcttcccaaagtgcttggattacgggcatgaaccactgtgcctggccctgtttttcagttttaagaattgtctgttgacttgctgctatgcaaaatgaggataccattgttgaacacacacacactcaccacctcctttcattttcccagggtagttttggattagagcaatatcctatgttacatttctaggataaaatgtatattatctgcttctgagtagtggaatatattttgagttaaattacttcctatatgcatttcttaaattaccaccttaccttatattttctcttttctctttcttttaagcttcttcattgtttgctatccaagttacagtctaatttgagattttctgaagattgatcacagtctgtcattggcattgggaaaagtggaatggaaaaagtctttttgcctttttagttttgtttccattttgaattccatacatgtgttattttgataaaaattaaaatgttgtaagagaaataaaagcaattactaggagcttagaagaagttaaaacttttttaagtacttgagattattatatgttcccactgtccaccgattttataaagagaagttgaggaccagagagactgagaaaacagcaccattccacagttaggggagccagggcttcaggccacatctgtctgacttccagtccaatctctgtgcaataccttaatgagaggtgggggaagaaggcaagggtgacatgggttggcatgctgtctgttcagaggataccttccaggcttggagaacaacactgtgataagccaccatgattcaatttgtagccagaaaggtaatccacgtcacaaggatgacagggctgaattacagagggctgggagcttctgtcaggattaactggtcacctgagtagaagaaaagacactcagctgtgaagcaaaatgaaacaattacgataagaaggccccgctcaggtttacttgcaactatgaagtactgttttctagacttgagcttagtttgggcaaattaacaaacttatatataaatgaacaaaggaagaccgtttcttgatcaaattagtcaaaatccagtgccatgtggcttccttgctaatgttagtttacttcaaaaaggggttatttatgctaatctttcatccatcaccccaagtcaattagcaaagtgcgcaattgcttaacaagtaatgcctatattataaaatactctctaataccttaagatgatgtatgaatgttggggttttatttgtacctctcactatccctttatgttacaggcaataatacaacaggccattaatgtctatttagtaattgcttgtttattaagcacttaactgaagtgcttctcattaacgggggggaatttaaataagaaaataataggaaaataaattgttgacaaatggatgtcatggcatatggctactgttgtcaaggcttgcagtgatcagcatctcaccttttttcttctttcacatacttatcacatttcttttgtgttctagtgtctgagctaggtgttgggggtgcagaaatattctacaagcagtccaaatcctgaggacacggaggaaagagccaccacctgtctgtcttcaggggaaaggtaatgctttagttaagcttgagtggaagttaagctttagttaagcctagatgttaagcttgagtggaagtttttccagcagaagagggtggaaaggctcactctgaaagggcacaaggctacaccaaggcttgtttcctttgcctctgaagtgtctagtcatcatgagcaggtcttcctatggcactaagtgttttatctatgaaaatatgattctttagaaatattttttctggtggttatgataaactcctttaagattttaatggaatataatttacttcacatatgtaggctctaaggcaagcttgtccaacctacaacccgcgggccgcatgtgggccaggacagctttgaatgcggcccaacacagattcataaatttcttaaaacattatgacattttttgcaatcttttttaaaggtcactagctatgattagtgtattttatatgtggcccaagacaattcttcttcttataatgtggccgaggaaggcaaaatctgaataccctgctctaaggctaacagatcttcatataaatcccaaatcctctgctctttaccatgtgacttcaatgtactaaatctacttgaaattgtctcctcattttgaaattataaatagcatagcctatgtgctagagttatgctgagtattaaatgatagaatgatagtaactagcacactgtttttcatctcattttgctttatttcatgtgactgtgttataatatctaatgtgaatgaaaaataaacaagatttggttctttgcaaagaagaaagttctaaagccttagaagttagtttcaagtttctatgacctttcagaaatgtattcatggatcaatagatacattgaaaatggatatttatgaacgtcattgcgtaagttcaagaaaaagagaaaaaagtgatattaacaatggctgaatgttgcatgatgtctttcctcatagaatcagagtcatgaaagtatttctgagatgaagaaatatttctgagactgggccttgatataagctgtaacaaggctaaagtaggcctttctctgggctagggacacattaagaatctggaaataatatgcatatagtagctgtttaggccacgcctggcaagtattctgggtatatatttcctttaagaacattaccagtgagattggcttgggtgctattgatttggctggcattcatcaaaaaaaaaaaaaatgaagaaaagtagacaaagaatttaaattaggggttagatctgctgaaaattataaggctgagatttcctttttcagtgaaaataacaagaagcttaattactaagttaggaatttctaatgttccctcaattccaatacacacacacacacacacacacacacacacacacacatacaacttgaagttttctcctccaaatacttacaatgttttataatttgaatgccactccaataaatatgttcctgaaactgttctgaatcttcattccagacccctctttagttagctgaacattcccaacgagtgagtaagtccaatatggtattgattgctgttttggtgttaggtattaaaaaagattatcattattgacaagaaactagtctctcactttgccctgttggacattacctgaattgtagccaagagtagccttcagaatctgtgtgtgagggtaaccatgaccttgagtagccatctctgaacactgcgggaaacaggaaaggaggcatgtgaggtagaagctcacatttttccacagcactgatttttggctgctgttcaccttgcagtctcttctgggaggcttcacagatccggataaatgatggtctctgctaatgttacatgttagaaaagcagactgggggttggccaggatagctgaccagaaacaccagtattataggtcacctactaaattccagctctaatgatatacttttggaataatataaagaaattttctgttacttaatggcaattgatagattgcttattttacttttatttgaaatgtttcagaaaaattccatccatgtaggctccaggacagagtgggctcttctcatgattcctctaaaataacctggcctggactggacactcttacctatcataatcccattatttcagtgtctggcctgtaagctgatatgttccataatgggcctgcacttagcacttctatgaatctcttagttcttgatattctttcatatttatgcatcattctcccctaaagctcataagccaccaggatggtacagtgtattctcaaaagcatctaaccatgctcagcatttaattgtcacataaaatgctctctaaattacagaggatgataattcatattttagcttcaaattatctattttgagagggctaaagtaaacaattttatatgcagatgattatttagatagtaattgatttgtggaaaatataacaacttgaaagtggaatatgagttgtagtctttgtttggcctaaaagtgtccaagctgtaagttataggaatagtccatgtaaatccagctcatctgaagctcttttactaattcactgtgcagcataagcccactcactttgtccccatgtgatttaatcacctacgtagagtgaaattactagataaatctctttccaatgggaacatggtcaggctccttgtataagaaattaatttccttgattgcgttgaatgtaaaatggaataacattaagtagagtatttatttttaccactgatataaggactccagtttcagctcagacatgtaaaagacctgggaagtcgttatatctgccccacagcaacaagaaatctgagcaaaatgaaaatcaatgacttttcttggacccatcagaaaactgagtttgtagcgtttgttagtctgcattgctatgaaggaatacttgagaccgggtaatttataaagttagttggtatattttggctcatacttctgcaggctgcatgggaagtgtggtgatctgcttctgatgagggcctcaggaagcttacaatcacggcagaaggtgaaggggagccattgtcatgtgtcaagagagggagcaagagaaaaggggctaattttgtgtttttagtagaggcagggtttcaccatgtttgtcaggctggtctcaaactcctgacctaagggatctgcccccctcagcctcccaaagtgctgggattacaggcgtgagccaccctgcctagcatggtggtgcatgcctgtaatctcagctacttgggagactgaggcaggagaatcacttgaaccagggagacagaagttgcagtgagctgagatcataccattgtactccagcctgagcaacaggagcaaaactctgtctcaacaacaacaacaacaacaaaaaagagaatatgggaggttccagtccctttttgtccaggaactcacccaacatttacaaaggggaacaaagaagaacctagaaaaagttcatccctcactcctttccccacacacactgtagtgctggctggggttggtggaagaagcagccactgccaaatctacccagactatttccaactatgtacttcatggataaaaggcttaatctggagggaaaattatcaaagttaaccctgagacactgttttaatttattaaactgaaagatggaaatagagatcaccaccaaatctctaaccagaagcataatcccagtttcccctaagcaaccaaagtctcaatctgcaggagaaaaggcttcaaaaccactgcaatttgggaaaaagaagaggagcaataagatgaggaagaatttttatcccaggaaaagggacaggaatagctgtgaaggctacatgtccaggacttaggttttgatacgtgccaaaatctttagctaaatgtgaacatcagataaccttcttcttagccaggaccaccaccactgtaaaaaacagcagtaaaagtagcagtggaatacaactgtgaagaggcacatggggagactcagtcaagtgggagccaaaaaagggcaccaatggagtggccagaaagcgctggtgcccatggcacaaacagtttcaaatgcagcttgtcttctgaccagatgaacatccatctccacatttaaggcctcacacaaggaaacttgtgcttttctcccaacatataaaatttatctaatatctgctgttcttttcatgtctagctataaccaaaaaattataaggaatattaaaaagcaagaaaaaaagtcattcaaagtgacaaagcaattgttagaactagacagagccatgacacagaggttggaattatcagacaaggaatttgaaaaagaaaactctgcttaacatgttaacggcttcaatggaaatgctagacaaaatgacaacactcagtgccaggtggataatttgaatagagagatggaaattataagaaaaaatcaaattgaaatactggaaataaaaatatagcaatggaaatgacaaattcctttgatggactcattagtagactggacatggctgaggaaagaatcagtaaacttaaacataggtttatagaaacttactaaactggaagcaaagagaaaaaaaatgaaaaacaaaaccagaacactaatagaacatcccaacactgtgggacacaatcaaatagtgtaacatatgcatagttgcattctgagaataagaaaaggagaagggagtataaaaaaaattgaagaaataatggctgagaattttctaaaaccaataaacaaaactacaggcctaaggagtttagaggaaaaaaaacagaattaatactgaaaacacacacacacacacacacacacacacacactcacaaacacacaccccatatcctattcaaactcccctgaagccaggacaaaaagcaaatctccaaagaaagtgggaaaaaaaaatcatgctagtcacagaggaacaaggataagaattacagcagacttctcatcataaattatgcaagcaaagagacaatggcatggcatacttaaagtgtagaaagataaaacagaaagataaacacaaaaatctgtcatacatagagcaaaaatattctgcaaaagtgaaaaagaaataatgaaggctttctcagtcaaagaaaactaagggaattcatggctagcagatatgtcctaaaagaaatgggaataaaatggaatcacaaacatacagacacaaaatttaaaaataaatgtgatctctgtcagcatagggcaagatccctgcttgttctagtctctaatatgtaacagaaggcccactctctgatctcagcactagcttgggtgcctcttctaattccaggtaagagatgagagcttttgcatgagctgcagtcatgaatccaggggattggcagcagagatgagagatcaaatcaggaaatagtattcaagatggaaattaaattgggaaacaataggatgtcacagagacaggaatactagagtaaaaaaaggaaaataaatgtggatgcagggaggtattgagatcttggaggtttccagagacgagggggtctcttcttaatgacacgtttgcataaaggagtggaatccccttcaatgaggttatagaagtggcatatcctaaatgcatatcaaagaattatctttaattcctcagattgctcctcagcttctttcagtcatttacaatcggtattaacatctgttgctctgtagcttttcagtctgattgattttaattactttatcatgctcagtgaacagattataaaatattgagtacctaaataaaaactaattaatgattctatggccacaattcaaaaacagtggtcaaacagggaaacattttctgatatatttaataacagtgttagcaatttttacagtagaataaatactaaatatcctttagggaaatggcccattattctttgataccttagaaataatacacaaaagaatcctcaaagatagataaaatctataactgttagtgctgtatttttaataaaatattcccactgatatctaagatacattcttgatttaaaagagtgacaaagactttattctgattggctgtgttgagtagaatggtacggcaaataagtagattaagaagagaggcagagaaagaacgtggtttatgatacttgcaagactcaaagcttctgtgtgccacaatttccttatctccaaaagagagaacaaaaacaactgctggtctttgcactgggactgaccttagattggaaaatgacctctttagtttcagataagaagtttccaatcttgttccaagataaactagtttacttagcttttctattctatgagatgtctgtgaagtaaggacaattatgccttccttataatttatgaatgaaaaaggctgtatcagttaataatgctttcagctgtgtggagccgagagcgactccaactttccccttaacaaatatggctttgcttccctcacttcccagggagcccagaggcagctgagccagggtcaatgtagcacattcatactaagcttcccataactctgagtgaagtgggtgggttcatggccccaagagtcacaatttctccgatccaattctaacatcacatctgcattccaagcaggaagaaggaatagaaagagaggcatcagcagagttctgtgaatgctggactgagcacatttatgttacgtgactgtcagaagctacactgaaggctgggaacatgaacacttagctttttctatctttataataaaatcacagtaggaaaagtggaatttggtgagccaattctcccgacacaaaggaagccaagggcaggggaaagaagtagcctaaaccaagaactaatgggaaaatagggcataccctagaatattggaaggggggcagtgattgatggactagatatttctttcctctgaaggtagagagcacctggttgcatctgggatggactggacgaaactggaaatcttatttagaacccagctgcaggttgccgcttttcctgagaatgatgaacgaacgatgcaagtaaacatttcaaagtgtcagtaccaagcctccacctcatccattttcataaagactttccaaagacctctgacttgactttacctgtggctttaatcctcattcctacattgctcctgacacggtttccaacctagtgtacctgcctaggtttgcctaggctggcacttccaccattaacatctgggcacgatggcaaaggttttcatgccataaaatgtggactttatcctgtgggaaatgtaggttttaaagcaagggagtagaatgaacacatttgaaatttagaaagcttcctgtgtgttctccacagtgtggaaatgtatttggatgggtgaaactgggggatgttacaacaattcaggtaagagatgagagctgagccaaggtaatgttaggggagtggaggggaagggtatgagagacaggaggtcactgtgcatttgttgtggaggattagggtgtaaagctggtcaaaggtgctgacaagacttcaagttgagtgaaaggtccaactttcgtggtaggagaaacaagctttggaagaaagatatagagttaaatgacagaccagataagttgaaattgcctctggaaatgcaggtagatgtgttccccagaaagaaagacatatggtgactgaaactggcaataaatgatgtttctttctggatggaattccagaatttgaagaaactaaggccgaggaaataaactgtggaacattgatattcaacaggcaggcagatgaaagtgaatcaggagaggaaagtaaaaagtagagaagagaaggggaaaggttaaaaaaaaaaaagaaaagaaacagatgccacagaagtcaaaccaggagagaacttctttgtttatctcatagcatggttgaatgttaatagcatgtagtgggtgagagaatagtctccagaaatacactgtctgcttcaaatattgcctttaccatttattaattctttgatttgaggcaagatatttaactccttcaatgttggttgtgagtgttaaaatagttaatacaaaaaagcaggtagaactttgtaagtgtatagttgagtgtaaataggtagcagtcagcaaatgcaacttaatattataaaagatgctatagctcccttttagttggtgagattcttaacgtgaaagtccattttttcttgtcattgctgtagcctcaaaactcaatgaaggaaacattgttgacactgtgtagttattttaatatcaaaacaattgttgttcacttccagcatttgaacaaaagagagaaagagaaggagagggagaggaactaggatgtacaaaacctatgctaatgtttagtgttgttttgttttaagcgcattttagctatgtttttcaacttctcttggccgtatgtgttaaaaatcctgcatttttttcctaatgccaggaaaatctctagaattcagaccactgagagacatccactactaccacaggggtcaccatcttctttcctttgcctttaaaaattgaagtgttatgtaaatacagtgcaatgtggaaatctgaagtgtgcatccaggtcaatttttagctgtctgactttcaatgagataaagatacaaactgtttctgtcactcagaaagtctttccatccttttccccagtcaatcttcacagcagaagtattcattatgctgacttctgtcataccatgctctacatgttcttgaatttcataaattgactcctacaccatgtacttttcaactccacagaatgtttttgaactttactcatgtggttttatggcccgttgttcattccttgtcattgctgtgtaatattccatcgtgtgatttatgacgatgggtttatcgagatgaagcagctgtccttttcaggagggttgaccagactgtactgtgcaatcactaagaatgtgggagttcttgcagaatcatcccactcctttgaagattcctgacttccaaccacagagttgatcatcatgtgacctggttcacagaaagaaaaaaattaaagggatttgggggtgggggtgggaaggagagacagcagcactgtccatttgttttctctgaggagcttaaatacccttcccatcatcccctagttttaaggaacaataaagaataactttctgggtcccttgggtgttttcattaagtagccacagaaagtgctagctagaaaagtctatagcgacttatatacagaagtgataacattctaaaatgggcagttttggcttaggggtggaaaatagttctcatatctcctaatccaatacctgcttttggggaaactttgatttggagaacagctagggtctagctgtaccctcttttaagttattttatgcccaaagtccagcctagcccttgtggagtagacatctgtcaggacagctgcctgggggctgcatgctggagacggaaggaggcagaggtgcagagagggactaacgtttacctctgaaatgctcccatgaaagattgtctggatttctgcttaaaagtactttatttataagatgaactagctgaacttgatataactgcatatattcattaccaaaatttaatgtcatctttccaagctcaccttttaatttgcaatcaaaacacaaagaaataggtgtacaaatgtaatataaacacaaatgttgcatgtagttgcaaaatatcagcacattgtaaaattggacatactatatggcttcatttggatgaaattactttaattaaaatgagaaagcattgaataatcttagaagtttgaatgtgcagcaaacagcagaatgggtgagagtgagccttctgtaatgaactctcctgaccaaagtgggacttagtggcatatacagtgatccatcaggggtgccatctgtctatgggaattcattgctaaagtaaggtcctcttaagttaatctttcagggttccttgcacaaaggataggtcttaccaatgacgtatttggaacacaaagcttaaatacttcatatatgaaacaataaaatgacttaaattcccttctccaattttatgaaacaaacatcacttgagatgcactatcttaggggaaagaaaactgtgcactaagcacttaccatatgcaagatacagtgttgaacatcatcgaattatatgcaagtgatatcattttgtttttatgactactatataaatattaatattctcagttcacgtatgaaaccaagccatgttcttgggttatatagataccaaagatctgtttttcacagtcaggaatgatgtgattctgggcttgatcttattccctgaacttctggtcatttttactatagaagcttaaagagaaaaatcagttaaatctttgggaggagaaaattttccttatgaatatgcatggccttatctctcaatgccttaggtagggacacctatttgtcttggaaatgaatggtactagttttcttaatagcaggactaatgatgtgtggctagaacacaatcagaaaccatactagtaataaaatcatggtgtactttatcatatagttctttgatatgcatagtcaacaatgtactgagaatgaaaaatggtgcttcacaggtaggactagtctacttacaggaaagcagaagtacaggataaaggtagagccaagataaacattcctaggatgccttaggcagagggtaagaagacaagggaaccgaggcagcaattgagttttgaagagtttatctggactctggagaaaggaaaataagtcagaaggacactattggtctaggaaatgataatattttatcatgattatgcttataatggtaaggaaggcagaaattggagattatggcaatgattaagaacaaacgtattcgggccaggcgtggtggcttacgcctgtaatcccagcactttgggaggccaaggctggcagatcatgaggtcaggagatcgagaccatcctggctaacacggtgaaaccctgtctctactaaaaaaatacaaaaaattagccaggcgtggtggcgggtgcctgtagtcccaactacttgggaggctgaggcaggagaatggtgtgaacctgggaggtggagcttgcagtgagctgagatcatgccactgcactccagcctgggtgaaagaatgagactccatctcaaaaaaaaaaaaaaaagaacaaacatatttatatttatagggaatgaggacatgggagaagaaaaaacctgagattatgtcagaaggaattaggttctaaaataagtttagaacttcaactgttaagcattttggggaacagagcttcaaagcatcacccttcaaacaggttactaaagtaagaggtagagaccatgagagcatagagcgataaggcccagtgcttagggaactcatttgcaggagatcaagttgagtggaaaagtgcaaaccagaccatcatagtcagtgcatgtctggcagtaaccctcagttgtagattgtaggtgtggaggtaagcatggttttagtttgatatacaccagagtacagattgctattaaatagagagagtgaataagaatcaatggctttattgtgtcatcacagcatctcaatttttaaaaactaccatgaataaagcattaataggaaagccagctacattgctcacatgctgcattttattattcatgtaacatttctgattggctaaaacatttcagtatatcaggcaatatacccagttctagaaagacagaaaaactagtcacaattgctggcttaccatccaatgtgtgtgtttacatgaggggggagaagagggagaccatacaaataccgtgcatgtgtcaaaggagctgtgatgtacagagtgtggaaacaccaaggagagaagagctagtttagcagctgcggtaaagaacggaagtagtcactgagcttcccatcctccaccagcctccaagtgcccttgtctttcacttcattattttcatatgattgatcatatataaccaacaccttagtccctcacttagctgatcaatttgtagtgtctccacataataaaatatcaaagaagaaagccacgatagtctgatgaaacaccatcttttcaggacaactatttgttagcatctaaaggcagagtttaaaacatggttcttcaatctgtgctctaatatagacaaatgagaagacattaatctaatagggcagtgtgagtccattcctcgaacagcaatgtgaacaatgaacacttggtccacaccagtacacctgcacacggctgaacttcagaattatttggagagtttgattttcaaagtgtagctccttaggctttatcatagactttctgaatcaggagtttcaggagaaagtccaagggtctgcagttatagaagcctcagaaggagacactgatgctcagcctaatggagtgaccaatattctaggagggtcttaaaactcagactgaagcaccatggctatctctgtggattctatccatcttggagctgtctcagcctctggtttccctgctcctgcaatcctgatgcaaacctgttagggcattctttctaactggatcctctgattatgctatgtgctttctcagagttactcagtttcctctgatctatagatctgttaaacacactctacacattcgccctgccttgcctttggctgtggcattatgcctatctgttcataatgacagcctagttctgccagctgactcacatgagctaactcttactaccctatattccacgttgtgacaacatttgactactaacctacttcatagttcctatatggaatcataatttttgtttttgaatattgtaagtatttgctgtatgaaagaatgaatttttctctctgtggccttttctgcaaaacataggtttccatgacaagtatttgaaaatacccaaattgctgagacccagtgactggatatttgaaagcactaaaagggagagtgatgggtttgactgccttagaacacttcagaggacttggtcccgatcaatcactctctctaataccagcactttccctggctataccctctcccaaaccactggctttcaagttgtcttttatcctaagcaatttgcataatattacctagatttctcagtaagatttggaataaaggaaaagaaatccatcttctatcttgagttcagctctataattgcaagattcgcacagaggctgaaaacttccacaaagcatttatttgcccttgggtgagttgccgattctctggagcaatcttctcctcttttgcatgcacagagtaaggtagcagagatgaaagacagctttgagcttcagctacaaatcagagcagaagggtgatgctggacagcctcagaattgtaactgatccagcttggctcagcagtgattggaagtaggtcagaaaatggcagtgctggagtccagactgtgcgggagaatactacatcttctttagtattctaacagtttcttgtcttgttctccgactttttactccttttttctctttctgtagtttttaatctttgtatgcataaagagacaaaaatagctaagaaattttgatgtagaaaagtgaagagagaacttaaattataagataataaatgtattttaatcttaacaatatttataacactgaggtcatttttcaagaagagacaaatagatcaattgctcagaatgtgaagcccaggaaaacaaactaacgtaaattaaaattaataactgataaatgaacatttaaatcgatagtgaatgtatgaaactatttaatgaattttcttgaggaaataatctatcaggagaatttggttaatttgccaccagaataaatactggctgggagagaaaagtcaaaatgtattttttaaaaagtagtcacaaaacaattgagataaaactgagaataatatttatttgctttggcagatgggataacattcaaatgatgaaaattataaaataaattaaagaaatggatgattaaaaaaattaaaaagcactgtacatgaaaagcaacataaagataattaaaattcatgcagaggacaaatacaagcattgggagagtattctaaaaatacatagaatttatatacatgaataggaaagcactaatgtactaatgtccagaagtgaaaagggcaaaggagacacaaaaataatccacaaatgactaaattcaaatggctaataaacatatgaaaggctttgttttgttttgatttgattttgatttttgagttaaagagagcgaatgaaaataacattcatggtagtttttcagtgctagcaatggtatgtaaagattagcatactcagacactaatgtgagagagtgtataaattagtagaggcattctaggtgcagtttggtattaggagtctcaataacatgcaactcctttaaccctataatcctgataatgagaattgtaagtttccatcaaatatttataaaacttttcattgtgccttcattttaaatgataaacaatgagaaacaacctacctactcatgaagatttccagtatgtttctgaagtgtttttacatcctcctcacaaggaggagagttgacaaagactacccaatgtcattatggtggaattgaatcatggcatctgctggtgaaataccagctgtgactacgtctgcagagagtagctctcacccagcaagagatggtgcaggtggtcttctgtacctagaaagaagttgagaagcatttcggaaataaaacttgcaaagcttggctgccagctgtggatggtctgggaaagagatggaaaacattcaagagaagctggcatttgtaggtcaatgaaccgagttggtggagacaataaccaaggctgtgagaatgaggaaggaaactaggcagaaacctccagttttcaattccttttggaactgacaaatgagaaaacagctacagagagacttgacagttcatctgcataaaagatggatggaattaacatttggggaggtccctactctgtgtgtatcaaacctatttcttattctgttttatttaattctcatggcaggtaaataaaatttttagatttaagcattcaacaaacatttcttgcttgcctgctatatacctgacttcatgttaggtgctagggagctggggacatagacgtgagtgcaatatacttactccctcttgtagagttaaataatacctatgatatcagttatctagcagcagaggatgaaaaatgtaagcctatttatttttaattttctttaatttttttcctcacttcaaagcctccctgctataccagtcttttttcttttcttctgttctttgagattatattttaggtatatatgtcatctttgcatatattgtcttttaaaaaaaaacacaggaaaatataaaatacctttcagcttcacttgttcccttttcttttgcctcagataaccaccatcatcaaattttctatatattcttccagtcatttttcagagcatttaatacaaatataactatagagaataatatttattttccatataaacatggatattttgtctataatagtctgaaactttttataatcagcaatatattttgagctcttactacatgagtgtatttcaatttagtttatttttttcaactactctatagcaattgtgtaaagtaatttatttgcccaatacagtccttaagaaataaaacattatcaattcagttgaaagcaacaatgtataccacccagatcaaatattctgctgccttatcagagggatggtgatgaattaacaagcctgtgaattgcattttgcttggactatgcttgagtgacaattgggtacaggattacaggcttctggttttctcacaccattctgatgatattattttactaagttccagttttccattgctgctactaaaagcatctatggtccatgtaatttttgttcttgagtagcttttgctttggagttctacagtttcactatgactgtgcttctgtggatttctggttattatgttattcttacaattattgaccactgaagtctcagaattaacattgttaatttatcctgtttagaatttcaagaagtgtcctcatcaaattctagaaaattgagaattgcctctttcacttatattctattaattcttctgaaattcaatgagatatgtattagaactgctcacttgttcatagatattaattcctcctttatatttaaaaaattcatttttctgtgttgtaattttgttgatttttttctaatacatattctaattcaataattattttttcagttatggctaatgtacttttcaacccagctatatttttattttaatgtttatattttatttcaaaaaattttttaaacagtcataatatttataataatctcttattcattcctgtagtattcaattacttttcttatgttttaagcattttggacatattccttttctagtttgtttttgttcatcctaatatctgaattatttgagctctaaatctggttttcattgtgtgtgcttattctttctcacagttgcttgttttgttttattaactttttagtttttatttaattctgactcatctgaatctttgggaatatcaagagcctggattgagggtatgtttgtctaaagagaatctgtattttatttttcccggtgcaatcaacctagaaagtagtgggagtgacttctgatgagagtggggttttttttggtggggttgtgtttgggggagaaaaattatttaaagttagatagtagcggtgtttgcataactcttgagtatactaaaaactgctaattttcatactataaagaggtgaattttatggtatgtgaattatatttcaataaagctgtaatacaaaaattagccaagaggagtttgaatcaactctacactctcagtcaaactttcctccaaatagtaccaagatgtggagctgtccagcggaaaaaatgtgtcagggcaaagagtatgtcctctacgaacaattcaagaaaagaggggatgaaggcaaggtcaaagctcagcatccttgtcagaaagcaaagttttaatttttcttcagctgtttatcaatatctgcttcattaataacaagtctctacatttttgccaatactggtttattttatttaatatttgctaatataatagattttaaaaaatctattctcactgctttttaatatgtttcttagattactgttgtgcctgaagtgttttttacattagctattctaattttttatttttaaaactaagttgccttttaaaatcctttacccatgtcctaccataaaactttttctcctaatgagttttgagagagattcataaaacaaagattctagtcatttgttgcaaatattacattctaaattgcttcttgctttcaattttatttataataacttataacttctatttcggggttttatatatagttctttatcacaggacatcaacagtgttaaattaagtaggtactttttaaaataagaaatatgtaaatatttacatttctttaggcatttctttaagtaagaaattcagcaaagccatatgggacataaggaaaatgtccaaaaaaaaaaaagaaagaaagaaagaaagaacaacaacaacaaaataaaaaacctgacaatttacatttagtacacataaataaaaatttacatagcaataaaagggccacaaactattcaataaaattacagactttttagagctaaacttactatagaacttagtagctgtctctgatgtagagatggcagtaagattttcctgctaaaataacaactgcaaagacggttttgggatgcaaaggattatgtgtttttatttagttgcaggaaatagaaatagaaacatttttattcttagtgactttttttttcctgtcaccagccattggaaggactacaatgtgaaggctgagatcaatgatcttattagtgactactgataggagtaggggtcctggaatattttgtgtctatactggcccgcctggcatctgacttcaactacactggctgggcagcatgagagctgaagacagaaagaaacacattaagcaacttttaattgtggatatttaaaaaacatttggttatcagatcctttcctactcaaagacggcaggaaacaggttctagtagggagaagaaaaaagaaagtggcctaatggacaacgatgcaggctttagtcactacaagtgtagggaggggaagacagggaaagaggagaatagtaaaacatgaccacaagattagcaaaatcctaaaagttgatgagattgctgagcaacaggagttcttgtacatggatagtggaagagcaaactgatgaaaaacctttagaaaactttggcagcatccatagaagctgaacatccttattcagcaagacccctcccagtcatagtcttcagtcagcagaagcatatgcctgtatgaactagtgcccatgtccacaaagaattagccactctctaatcctttaacttgatttcacagagcatgatactttcaataagattcttagtgacagagaaagatagattaacgttgctattagaaggctctgtttattttatttgtttatttttttcttgctcacattattaagaatggcctcacagaaataaactgctgggatttcaaatccaatactctatcgtgaagtacttgaacacagcaaccgtgcctcactcccttattgttcatccccaaatctaggaaagtgcaggcatttttcagggactcaatatgtaagtaagtactgaatataagcttcttagatgacaggcttacacatttcataaacaaccaaaaagcaaaacaaaacaaaacaaaaacaaaacccaaagcaaaaaccttcaaattttcctaaactaacatataaaattaaggagattttgtgtattacaatcattgtggtatttattaaatgtgccataaatattttataccatttctactagtaattgatgacttttactatgtttttgatgccttacaatgaaacaaagtatttggtggtaacaatgtattttaaattatcatattgaatatcttttacactataacagaaatttttgggaatgaggtgaaaatttgctctaggtttctttatgatgtaaatttatcatgggattctcttaaatgatgagcttgtcagggtagttgaatggcaggtctctgttttagtggtactttccctaacctccctcccaaaatagcacccctggttcattcattcttctgcaaccttacactgtattacatatttttatttgcccatgttatctctccactagtagaatataaactccttgaagacactttgtcaattgtgttcattgatgtatctcaagctcctataaatgctagtgacctaagaacttacccatctaccctcagaatatgtctctatccagtttcttttaggggcctcgagatagggctgcttccagcagcgctctaaattctcagctatgctgattattctcagtcctcggctgtagcaacagtgctctttcccttaattttattgtactttcagttctgggatacatgtgcagaacgtgcaggtttattgcataggtatacacataccacggcggcttgctgcacccatcagcactctttcttagtagttgacagtacagatggtcacgatgctgggctgacctctgctggccaccaggttgcaaacgcgaatgctagtgtgtttcttcctcagggcccagcaggagaattcctttgagctttgagcaattctttcagagaaaggagtcttctccccaccttttgtttaactatagtcctagagaggtagggatacagccaggcatagtcttccattattcctgattccgtttctcaaaccacgtgcctgtggccccatctgacactctgggcttgatttcttgaggtatgatgattttctcaaaagatgcctctgtcttcccatgaatctggtgtttttaggagttgcccaggccactcgatgtcctatatgtgtttatactccagtcattaacaacttccatcaagttccttgccactgggtttctcgacgcaggagatgtgaatggacaactaattcaaactcctggagcattctattagggttaagaatttctcacgtataccctcgcacttaggagcctcctctgccctaaatatgctggggacatctttggtgtgttgtggtgtctcctcatcagtaaatgaggtcttacgtctgtatcagcccaaacagtaaaaacagtggatcacaatcacaaagatagaacagaagaataggcaagacttctattctagtgctcttttccaggataattggtttttggggaggaaacgtagagttcatatgaacggatataaatggagttattctatgccaaacagagcctatcatgaaagctctgtaagaaatctcttccctcctgtccccatatttgcattcaccaccaggggtgtctctttcggtgtttgagtttcagttcctctgttcatatgaactctaaatttcctcccccaaggaccaattatcttggaaaagagcattagagtagaagagttgcctattcttctgttctacctttgtgattgtgatccactgtctttactgtttgggctgatacagatctaagacctcatttgctgatgggaagacatcgtaacacaccaaagatgtccccagcatatttagggcagaagaggctcctaacttttaggaccgtctttcctgctgcctcaggtgagcaacacacatacaaaaaaacttttctaaagtaaacagacacagatttttaggattgtgatacgtaatttttaaataaaaatatattcattttaagtgtgaatatgctaattgtagaaatttaaaaatgaaatataagaaggaaatggttttccagatcgcttatagccttagaaaccatcgttagcattttattatttttcctttcagctctctctaagagcagttttagatcatagttgctctcatgctttaattaaattgtgtatttggttttccatttagcatgaaatcagtatttcatttgataaacatcattttaataggttgcacattacttctttgagcaattctaccacaacataatagcctctcacttgaggaattttgggtctctagtttcaattgctgatactgatgttgttattttatacataatactataatactactcaccagtgaaaatgaaatagtaggcaatctggcagtatgtattgctttgaagttaatagtaataatactaataacccttgctagtttgggacctacaatgtgccactcagctgttttcatgttacctccttcagtccttaaaacagtgctgctgatagacactgattccatgtttcccagatgctcactgattaagtcacactacccaagtcatacaatcatcacaggtaggagccagctattagaacctagttcatctgaatctgaagtcaatgatgtttccattgctcaatgctgccatagataagcatgtgtatataaagttttccctgtcttatttcctaatgtgaagataaatgtgatttttttaattgaaatatgttatcagctaggtagaaaaaaatgaccaagaagtacactaggtatgaggaaatttcaacatgcacataatctctataagtataaatgtcccctagcattctgtactgtgggtaactgagaggcaagtgactcagattgggccatttgcattgttaaataattatttcttgctgtggccaggctcaatcaggactatgcacagttaaggtattacccaaatgaatggtgaggacttgacatgtgttgagagcctcttttgtgccagggaaaataggtagtactgacaaaagatgtgaggaacacattttaataaaatgtgacaactgtcattggatccaagaagtggatcatcaactcattctctggagtgagaagaaagttagacatggcttcccagtaaacaggtcagaaggatccggctgcatgagaagttgggggaagcagtacgtgaacagagatggtttccccttaacactgtcaaatgagaccctgagtgcctcttgaggacaggagcttttttcttagtacctattgtacttctcacagtgcctggctcacaagagtctgtcaatgcatacaaaatagatagatagacaaatagatatagagatgtggatggatagattaataggaagatatagaaaatagatgtatgtgtgagaaagagagagatagagatgaagatagagatcaataaacagatatagatagatgatagattagatagataaaaggatgaggaaaaatgggtagatagctacagataatgtgtgtgaaagatagagataaagatacaaatagatcaatcaatagagatagatgacacatagacacacacacttatacatgatttatctattctatctctctacatggatagatgatggctagatagatgaatataaaaataggtatatatacagattttcttctttctattgttactgcaagcctagagcatattaggtgctaaacaaataactaaggtttaggaaaataattggttaatggctgatatgtcttctcataaaccttgagctgttagcactatgcagtctcttctcagcacttcatgctttattctgtagcctggtgtggcaccgagccccatgttactgtgaggttcacacccaggacaagggttttgggcagcctagacagcccatgtcatctacattaaactctgctttctctttacattttttttcttttaaacacagcctgaacatgagtgagacaaacatctgtaaccttttctaacaatatcagaggatatcatttttatatttagaaggtggatgagattgaagtcaagaagagatgccggggcagctcatattattcacaagcaacataatcactgtgaaaatacaatcttttttccccctttggagacccagttactatatttttttaaaagcatttgtgcaagaaaaaacagcttattaaaatgcatgaggtctagcttgcctatcaccaataatcagaatatttttatctgccataaaatctcatgttgacaagtaatgttcttctcagttttgcaagtatgacgctattgtccatttgatttctccatcacctgctgacctacttcctgttactcacccagcaggccctcctgaggcaacctattgatgctcttgttggttcttctacccctttatctcataacaatctgtcagctcacccctccagagggtttaaattgccaccaactggtcaatagatgcaacctcctatatatcaatacgcctgcttccaccagtagctctttgacatcatctctcagataaattggtctctctcttttttcatattctgttctctccatgatgtcacatgaaatgtgaatgtttctctccagttggagtactacattgcttacatttaatctccatttattttcctcctacactcctaccccagagattttcagaaagtgagaaaagtattagaggtttggaaatgaatatacatgtctctaagcttttgaaatcttgtttccaaatatagagctgacttgatttgagaggaagaaaagcattagcaatattcttaaaggatgactttacagtgataatctgaattttattctgtgggcagatttcttcaatagtgattcagttatttataataacaacaactacatgaagaccaataatcatgaaagaacagtgatcatttttcatctgaacaaagtgtaattggattatcttcagagattctaaaaatcacaactttccaaagatccagtgtacatggtggatgtagaccagcgctgagctgtttcacgaactatcttcctgttaccagcaggtcaagggctggaagtctgtggaggaggacttgaagtccttaggctggcagccctcctcatgcagcggcaggccaggcagccctcatttctttccccagctccaggtcacacatggtagaatttccacctagcccccagaagttgtttggatcttgctgcccttgtattgtttggtcttgaggagtggctcttttctcatatgaagggaagatctgggtggattgccttccagaacttctgtcttcccctgcatccatattggtgtgaggaaccacggcagagtctgtgggaactgtgaacatgtaaaaggacagaatatcactgtgtaagatgactgtgttttctccaagaaacagaaagctatcagctgtctgaaactaacttttaaaatacgaaacaaaaaacagatttttttctccaaagtcagggagggaacctgaagctcggggttttctaaaacttctttgaatttaatgaagtgaaacactgaagatcactgggaaagggtgagttaaaagatcatagtgatatgctttcttacttaggagtttttgctaactacagcttattttcagaaggtgtgcatatcctgagtgtttctattatttttttgcttttctgcagcaataacataaaaaaaatcaaaataccagaccacatcaacacacatactttgttctttggaaagtaaatttggcagaaatagaaagaatcataaatatgatattttaaaaaggtgttttatttaaatatttaataatgatgaaagccccaaataatcaaaattggcctatttctattttaatttccaaccaaccaaggaaagcaggaattcatagactttggcaaggatattttgaagtgtgttgatgaagcttgtggtgagtgtgcactactcttcaccccagagtgaagaatggacacccataggaacagccatgtggctgtgacaaatgaagggccgtgccctaccttatgaaattgacatctggtcctagaattgcacagtcattgaaaccaatgtgcaaaacactgctaaatcagaaagacacttcagtgagaccctccttctctgccctatttaatttaacaccctactccaacatgccctttcccctttcctacctgtttttccctggcacttctatagctatgtattctatgaccacgtgtagccactgtgtatgacacttacttacttattatctgctcacacactagaatgtaagttcttccatgaaggaaggacttttgtttgttttacacatctgcagtgactgcaaagtgcctgaaatacagaaaacactcaatgcatatctgctgcatcaatgaatgaatgtgcttttaattacattagtaaatatttataatgagataaaagagttctactgatattgcagtgtaaatatctttaatggcagggcaaaatatgtaaattgaattatagaagttcagaactgaaacagaaatgagaaaattagaaattttccatacgggaaaactgagttcaagaaaagctataacttggcaatggtcatgtttgtagtgcacaacataatctaattctcctgagtccaaataaagccccaaatataacccattattattatgcattttgttgccttactactattagcatatagattatttgaatttatatacttttaggctgtgctatttgcatgtgtctgtattcaactgttgtttatctcaaaaatatgtattccatttggctcatccttaaatgtaatggcttaataactttattttttatcgatattttgaaaatatttttcataaaaaatgaagccttcaaatactggaggtttctgttgtatttaattttttgaaaatcattgtctctgctatttaatgaacagtattgtcttcatgtttttgtactgacataatagagttcctcagggtaggtaatttataattaacagaaatgtacttggctcatagttctggaagtgcaagattgaggggctggcattaggtaagggccttctcgctaagtcatcccatggtggatgatgagagggcaagagagggctgaaattgtccttttgtaaagaacccacgtctgagaaactgaacctactcctgagataatgagtttaatctactcaggagggcacatgccccgtgacccaaacacctcccaccaggccccaactcccaacactgctgtgttgagaaacaaatttccaacatatgaacttttggggacacattcaagtcatagcaagtattattcttaaaatatataaactaaatatttaataattaaaaatttgtggggaataaattattgtctttggggcagaaattaagtatatactttattttttccattaattaaaagcttccaattcaagataacagataccgtaaaactctataactttctaagacaatgttcaatactttttataaataaacatcattgtttaaaaattttagtttcaagaacatttgatttttcaacccattgagcgatgattacttatttatgaaggatgctaattaagcctagaaggagaggcaatctactacttgtgtgtatgtttatattagccaagggagttattgattaaattttcttcttttttattatactttaagttctagtgtacatgcgcacaatgtgcaggtttgttacatgtgtatacatttgccatgttggtgtgcttcacccgttaacttgtcatttacattaggtatatctcctaatgctatcctccgccctcccccaaccccacaacaggccccggtgtgtgatgttccccaccctgtgtccaagtgttctcattgttcaattcccacctatgagtgagaacatgcagtgtttggttttctgtccttgtgatagtttgctcagaatgatggtttccctcttcatctatgtccctacaaaggacatgagctcatcattttttatggctgcatagtattccatggtgtatatgtgccacattttcttaatccagtctatcattgatggacatttgggttggttccaagtctttgctattgtgaatagtgcagcaataaacacacatatgcatgtatctttatagcagcatgatttataatcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgatcactattctaactggtgtgagatggtatctcattgtggttttgatttgcatttctctgatggccagtgatgatgagcattttttcacgtgtctgttggctgcataaatgtcttcttttgagaagtgtctgttcatatccttcgcccactttttgattgggttgtttgattttttctcataaatttgtttaagttctttgtagattctggatattagccctttgtcagatgggtagatagtaaaaattttctcccattctgtagattgcctgttccctctgatggtagtttcttttgctgtgcagaagctctttagttgaataagatcccatttgtcaaatttggcttttgttgccattgcttttgtgtgttagtcatgaagtccttgcccatgcctatgtcctgaatggtattgcctaggttttcttctagggttttttatggttttaggtctaacatttaagtctttaatccatcttgaattaatttttgtataaggtgtaaggaagggatccaatttcagctttctacatatggctagcccagttttcccagcaccatttattaaatagggaatcgtttcctcatttcttgtttttgttaggtttgtcaaagatcagatggttttagatgtgtgatattatttctgagggctctgttctgttccattggtctatatatctgttttggtaccattaccatggtgttttggctactgtagccttttagtatagtttgaagtcaggtcacatgatgcctccagctttgtttttttggcctaggattgtcttggcaatgctggctcttttttggttccatatgaactttaaagtagttttatccaatcctgtgaagaaagtcattggtagcttgatgtgggtggcattgaatctataaattaccttgggcagtatggccatttgcacaatattgattcttcctatccatgagcatggaatgttcttccatttgtttgtgtcctcttttatttcctcgttatttctttgagcagtggtttgtagttctccttgaagaggtccttcacatcccttgtaagttggattcctaggtattttattctctttgaagcaattgtgaatgggagttcacccatgatttggctctctgtttgtctgttattagtgtacaggaatgcttatgatttttgcacattgattttgtatcctgagactttgctgaagtcgcttatcagtttaaggagtttttgggctgagacgatggggttttctaaatatacaatcatgtcatctgcaaaaagggacaatttgacttcctcttttcctaattgaatacgtttatttctttctcctgcctgattgccctggccagaacttgcaacactatgttgaataggagtggtgagagagggcgtccttgtcttgtgccagtttccaaagggaatgcttccagtttttgcccattcagtatgatattcgctgtgggtttgccatatacagctcttattttgaggtgcgttccattaatacctagtttattgagagtttttagcatgaagggctgtggaattttgtcaaaggtcttttctgcatctattaagataatcatgtggttttttgtctttggttcgtttatatgatggattacgtttattgatttgcgtatgttgaaccagccttgtatcccagggatgaagccaacttgatcatgatgcataagctttttgatgtgctgctggatttggtttgccagtattttattgaggatttttgcattgatgttcactcaaaatcgctcaactacagggaaactgaacaacctgctcctgaatgactagtgggtacataagaaaatgaaggcggaaataaaaatgttctttgaaatcagtgagaacaaagacacaacatgccagaatctctgggacacatttaaagcagtgtgtagagggaaatttatagcactaaatgcccacaagagaaaggaggaaatatctaaaattgacaccctaacatcacaattaaaagaactagagaagcaagagcaaacacattcaaaagctagcagaaggcaagaaataactaagatctgagcagaactgaaggagatagagacacaaacaacccttgaaaaaatcaatgaatccaggagctggtttttttgaaaagatcaacaaaattgacagactgctatcaagactaataaagaagaaaagagagaagaaccaaatagacacaataaaaaatgataaaggggatatcaccacccgtcccacagaaatacaaactactatcagagaatactataaatacctctatgcaaataaactagaaaatctagaagaaatggataaattactggacacatacaacctcccaagactaaaccgggaagaagttgaatccctgaatagagcaataacaggctctgaaattgtggcaataattaatagcctaccaaccaaaaaaagtccaggaccacacggattcacagctgaattctaccagaggtacaaagaggagctggtaccattccttctgaaagtattccaatcaatagaaaaagagagaatcctccctaactcattttatgaggccagcatcatcctgataccaaagcctggcagagacacaacaaaaaaagagaattttagaccaatatccctgatgaacatcgatgtaaattttcatagtaacattatttactttatccactgatgatgatatttaatatatttgctgaattgcacagtatccacttaacaaaatcaaactttaaggactacagcttggatttcttgtgccaaatgatcaaacagtaaaagcactgacaatttagcctagggatagccgcagtgatagatgaggcagacaagtcaatcgagaataatgagccataagagaaacaattgatcattttatttgactgttcgatttaaaatatgcacatggcttgggggctccctgtcacatttatacacagaaattcccttatttctttcactttttcagcacacattcattggcggtttattaagtggcagtcactctgcctgtcacaaagtcatctagaaattatagtcaaagatctcactaagcaagattgtgactatttgtgggtccccttcaacctactgtgatacagccaccactcaatatttattgtgtattttagggactgctctaggatagctgcaacaagaaactgagataagtgaggaattaggagctataagaagagtaacacttttcaggcaccatggctcacgcccgtaatcccagcactttgggaggttgaggtgggtgaatcacttgaggtcaggagtttgagaccagtctggccaacatgtcaaaatcccatctctacaaaaaatacaaaaataagccgggtgtggtggcgggcacctgtagtcccagctacttgggaggctgagacacaagaatcacttgaacccatgagatggaggttgcagtgagctgagatcgcgccactgcactccagccgggtgacagagtgagatcctgtctcaaaaaaaaaaaaaaaaaaaaaaaaaagaacaataacactgatggacaagtccatgggctattagaaaagaatacttaaggggaagttggatttatgaggcttgtgcagaaaggctaaatggatgaggtgacttgagtgcgccctgaagaaagaggatcatttccctgcagagagaagaaggaacagagagaaggaatggcatatgcacaacataaacaagtaaaagggcacggtgggagggtgcccttcagtgggctggccctggtctgtggtgagggagaatggtgaaagacagactgaagaggaatttggaatttgtcactgggaccaaatattgagttgggaacagccacagcagcacagatgagctaggaagcacggagaggcagacttcaggggatgcaggcttcatggcaaaaacatcataactaaaggtgagctctggacagagagtaaacctcttggactccctgcttcccaggtagatcttttttcttctttcacttgaagccacttaaaagatggagcaccctcaatgaagttaggggcatgggagagatccaaaataggtaaaggattttttatttgaaaaatgtgtaaaaaccaaagtgaattatgattcatacgtgcatttgaagggggacactgctcatttttaggcaaactatactgtgtgattcttaagttcccccagcaaaattgtccttctgagagggcttgtgatttgaaccctttcttcctgggagtaataagagtttttgccatttccagggcaagtgccctgttgtggcaccatcctttcccctggtccaggtgttctcccctggaacatgcaattctcatagtctgggagactagatcagagaaggtgtctgagcagggcgctgtgagcaaagcagatgatctgatgtgttatcccttccctaggcactcttagtgggaaactgagaatcacaaactctgtgtctgtgtctaactctccttttcaatgtgcttgttaagaactctgtgagcataaaaaccggggtggaggggaagctgaatggtatgaaatcctggaaaccaggaagcttcaggaaatggcttgtaggaaaagggagcttggggccttttttgaagcttgcagcaggcagaggagctgtgcaattcagcgggcatgactcataaggcagctgctggctgtgaagacatgggactagaggctgagtccaagcttggctggtaggttcccatcccagctgccagaccagaacatccctgagggtatgctttctgggggctgtcaataattcacttccagtttgttgctgcaataagaaataacattttagtacattttactcatttggagtttatgacatccttgcacttagagaaggtggtattactcccatcttacagctggtgaaagggaggttaagggaacatagccagctgtttggcctcacctagctggtaaactgcagatctctaatttggatttgtgccttctaagtcatcagtctcagggtcccccaatgctactattctttctctaagagcccttttgaggctgtgtctgtcatggcaacagagctgcaaggattgtggggtaagtgacagttctgggcaggagggccctcagagcaggtgacagagagtgagcagaggggagagagatggaaggctccgaggaggtcagaagctgctaggagagagatttttccccaagtcagcaaccttgcagcattggtctctatgaggagcaactcaaattcagctagatttaaaatgctagagtcttccagtgcactagcagagtcctacacaagagcctgagacaagaaaagacagaggcgaacgacacgtatcagcattcttgggatcatacacccactctcattctcctaacagtcattcagcttttgatttcagcattgaccaattcagcagaaatttctacccagaaccagtgatttcaggcctcttaaaaaccagtggtatttatctgggttttgtcttcagcagcctcatcattgcctgattgcctcgcagttctcgaggggaggctggcagccacggcagcgtctttatcataaagatgatgttacctttctctctcctgatttcccttcggcttttatgtagtacttgaaggtgaaatattctatagaacattttgtacagtatgttctcgtttctttaaaaacacaacacaacaaaacaacttgtatatgcacagaaactacctgggaatcaggttaacagggcttcactccacagctgctgctggggactggaatgctgctggcaggtggctggggggggtcacattttcttttatacattttattatgtagtattttttaaagcttgaattacttaggtaataaagtaacactttattgagtaaatggaaaatctacttagatatatgaaacttttaaaaaatagaactttaaaattaaagaaaactggattcttttacatttgcatctcagcatcacccaatatacctttgtaacagacatgcatatgtaccccctgaatctgtaataaaagttgaaaaaaatttaaatgcccttctctgagtgttgtaggatatactgatagactccggacgcatgtccaagtcagagtttggttttcaggttggagatgtcctggcttaaattgtctagaaagatgatatcttttactgtttctgtgccatgaagatgtgtgtaacataccatctccctctacctcccacccccaacaccatatgaaggagccatttcgttatgcaaagaatacaatctgaaatggcttaaggggacttgattggctaggagctgcccatggcaagcaaaacacatggaatatgaagatatggaactgctaagaggaccccccagacacgactttatgcagaggctccttcttagctgtgaaggatatgttcaaaaaccagcagcggcttcctgaaaccacggataggactgagccttataatacactatgttttttcctatacttacatacctatgataaagtttaatttgtaaattaggcatagcaagactaacaacaatgactagtagtaaaatcaaatgattgtaacaatatgccagcatcagtacctcggtgctttagggccattattaggtaaaataagagcgacttgaacataaacactgagataccgtgacagtccatctgaaaatgagacggatctgaaaagaaggacaggtttcatcacactgacagatgcaggaggctgataaggagggtcccttgaggatctctgacccacctcacaagtgtttacatcagacgcttttgatcagatgagaaaacctgcccagggtcttgtctgcgcatgcctggaatggactggggacctacctgcactgggaagatggggtggagccatgggaagttcatgccttgtgcagggggaggagctgggcctcttcagctagtatgtggtggctggtattcaatctgtgaggtgggagccattggcaggattccctctcactttgctgagtgttttctttctgctcttctcacccttcaatgtgtccacatgcctaattttttctggttaagacacaagaacgtggatttagctgaactaaggagcaaaaattctgcatcattaagatggcccatatggggacatgaggaagggtgcgtaaggtgcggatgaaaaaatctttttcccttttatttctaagactttttgttcttggacttcttcttagggtagagaaaactgcgcctgccactgtccatatcactctcagggattgggaatggcagtgtcagtccaattcagcctttctatgggattttccttccttttttcgggatggacaggcgagcagccagatatggcccaacatccctgcatggcagactggccagtgttccctgccatgtgtccaaagagtcttcacctccaagtcttcccctcccctggccaggaagtccagctccatctaacagcaataaggtttttctccctgttggagaaaaccatttgcctaagaataagaggtgatcaccccaagcatctttcaaaccctgcactttaagcggtttttttgttttgttttctttttcttttttttttttttacccagttagctgttaacacagccctgaactttaaatgttgttttgcttttttttcttttctcccccaggtcaggagttaacttttaagggagagttttttccatttagaaaacattttactaggccaggaccccaattatcactgtttatatcctctgtaaacagtgatgttgtttttgtgaggttggtctcaagctgtagccaatctggtgtactttgcatgtctttctgtgtaatcagtagcaaactttgctgcaggcctccaacttgttttatgtatttgggagtgtgacctgtaatcatgtggcagtactttgttttagcctccaccattttacaatgacagcccaggttcaatcctggcttagggaatgagttctttctggtttggtatctgcatcactgttgccatttattgattctcttctcctccataaaccaccttggattttactttctttaagcctttaaaatacttggccacttggtacagctaaagccaggtaataagggatttgaaaagattttcttaaagaacactcagcttaattaaagtggatatccaagttataatatatttaaaaggcttttatgtttttctcttctgggatcttgttttgatggaaaagggttttttctcagtcaactgaattatttttctccattttaccttgccactcttaatgcatgcatgaaaggggagagacctctgttttcctcatggggctccaggaattaaaagtagatccctctaaaaatctgtttttgtatttcggctatccctgtttattaggccctagaaaccacatgttttcccagtcttgctcttaaagggctccacccagaggccaataatccaattagtagatgggcaaaaaaacaaccttctagctattggatctttctctgtcggtctatgtagttatatatgtgttttgtgtgtgtgatgtctgtaaaaaaattagctctaattaattgacttgaagggaatttgtaagggggagataaaggttgtggtaccttttagttcacatgattttaatatttgagaaataagagcagccttaaagattactggtaaaatgcagaagtcatcaaaattaaatttttgcctagggttaaaggattgttttgaattagataagataaaggtaaaagtgcaaacaagctgtggaaggattgtaaaaattaatcttgcaaaagaaattccatgtgtgaacataatgactaaattcaaaagggtatgatatggtttttctgtaaattgagcattgaaataaaagcacaacaagctactcttaaggcactaatctgctctttggcaaaatttgtaaagggttagaaaaggtttttctttttaaaatttctgaatcatcattttggcaaaataaataacttatggcaatctggaattctatttcataacatcaagagttttaaacctctaacacatttaacaggcctccccaaatcaaacatcagtttcaaaattgtctttcctgacaactggcttttggatgctacagagagaatctgcagcatccagaagagaagtaagcaggattatttgacatgtttaagtacacaggattaccaaaatgatgtttaatgttctttatgttatattttagggaaaatattaatatatgttccaaaattgtatgggatttctaaagttctaatatctgagtatatgctatcaatcacaattaaggttgtatgttaagttattataaaccactgagataaccaaatgactttatcaattgtgtttctaactgtaactaccctgaatattttgtttctcagagaccattgtcttgttttgatcctcttcaaaagacagtttatagtcaactacagaaatttgatatctgctttcaaatgcaggtttctgataactttggagattgtgacattggaataaaggaaaattgtacaggactcataaagagctgaagtgttcatgaatatcaagcaaaacagagttacctgaatggactgaactaatagaaaactgaattaatctttttgacttctgcttggaacattgctgatccatgctttgtttttcagaatcaaggaaacttatcttaaccttgagtaaggtatactcctgtgaacaaaatttggagcatatttacctctctctctttctggcttctccagaatttggaaactagttgtgagtattcttaccttatggcaatatagttgtttgcatcagtgcaataataatccattttcttttgcaatgagatgcaattggagaaacttggtgtgtcaccaaggctttgactggaatggtatgcttctctttaagcagtcaagcttgactactagagctgataaaagccccttggtaaaactggcctcataccctgtctacaccatccctgtacagggttcctaacctgcagtgaataaagaatgtcactttttaacaggcccaagaaactcgttttcttgggacctcaagaaaagaggagtttacccaactcacaggtatttgagggtacaaacccatagctgggctcagctttaaaaatcctatctgagattccttgtgaaacagagttccatcaaagccaatgcaaaaggcttatgtaaaaataattattcttgtggaactttatgcaaatcatcaggccaagtataaggctaaactctattttgcaaataactcagtcatatcatgatttgtttttaacaaaaatgaggattggagagagagaaattatgtttcaaaacttatctcacatttgtcataaattctagactccttagttgtttttaagtttttgcttacatttcaggctaaccttgtttattcctgtgaaccaaccagcaatctccaactgcagctcagaaggaacaaaaggagatgggaaatgtaaacatctggatcaatattctagttctgagcaattatcctgcagatcctgccaggtgatgggaataaaacaggatacccatcatccagaggtttcctttttgggaaagtaaggccaaggcagctaaccaaagccaagccccatgcacccaaatcttggcaagcataactatagccaccagttatctgtgcatgtcacaagacatctttttctctcccttgttggaggaggactgaattccacagcttcattttagcatttggcttatagtaaggagtccatgcagccccctcaaaacatatttttggttccaaactcaattccaagctttgggtagaagtctcatgaaagaaaactggatctgagggatccagaagcagatgataatggaagttaaaaggcacagtgcaggtaagcgtgactgattcctgctgattaagccaagcttcccatttcatggataaagccatgctagtatccatagcataaatgaggtgtagggaattctaaggctactgaaacaggggagatagggcgtacaaagccccctggcccacgttaacataagtgaaagcctctttgattccctgtcactcttgctgggacttgggatataagaatggaagaaagaaagagaaatgactcactttctccccctcaaacaccctgggtgttcactagaaaagagtagggaacctgagatgcctcactcccgtctttctacatgagtagctattcatcttcagtgtgtacccctttcaaatgcatcctgaacccctaggactcctttgaaaaaaaatgccctcttttttctttttcctcctctgtcctctcttcacagataggtaattttgtctccatgctacaggacattccccttggatacatcctccaaactgggaaaagttaatttcccaaaccttaaactggttggcttaagattgggcttggggaaggaaacccagaagcttgacatgctggcaaaggggaaacatttgtttttttaccagtcaggcttttggcctccctcttcctgtgcgaattggtaaaaggccttgggattttttagctgtccttaccccaccttgtttccttttgatacatcttttctaacaacccagtttgtctcttctcaccttcaagacatcaaacttcaaatagtcatgcaaccagagcctctgactatggccccttctgccaggggacccttaggtcagtccctgagtgagctgactgccatttgcccaaagcagcgccccctgtcagcaggaagcagataagatcaatcttcatccttaccttatccttattctaatggtagttaaatatacttctttagactggggaatgatagatgtaggaagcagataagggtgggggggctgtccctggagaatctcccacctgccccacaaggatttacatcagatgtttttgtgcaggtgagagactctgcccagggtcttttctgtgcgtgcctgcaatggactggggacccacccatgctctgggaggatggggttgagtcatgggaaatttgtgccttgggcaggtaggaggagcctgccctcttcagttcatgtggggtggactggtattcaatctgtgtggtgggagcccattagcagggctccctcttgttttgttgagtcgttttttatttttatttttattttttcccctttttgcccaataaattctgctctcctcacccttcaatgtgaccacttgcctaatttttcttggttacagctgaatgaaggagcaaaaattctgcatcaacactatgcagaatggtgcacaatttaaaccatatgaattgcttatttctggaatgttccattaatattttaggaccacagttgatcttggaatattgctctgtaataccccataataatattgaaaaatagagcatatagcaaccaatacatggtaaaaacattctatttcccaacttcttccaccagcgctacgatttcagccaataatttccaagttattaaagttttggtgtttggctttaccaatttttgtttcactacatggcatgggtctcaattgtttaagtctcagagaagcttcctcgctgcatgccacccaaacctaaagccggtggcttcattttatatatatatatatataaaatgtgtgtatatatattatatatatattttatatataatgtgtatatattatatatatttatatataatgtgtatatattttatatatataatgtgtatatattatatattttatatatataatgtgtatatatattatatatattatatatttttatatatataatgtgtttatattatatatattttatatataatgtgtatataatatatattttatatatattatatataatgtgtatatatattatatatataatgtgtatatatattatatatataatgtgtatatatattatatatataatgtgtatatatattatatatataatgtgtatatatattatatatataatgtgtatatatattatatatataatgtgtatatatattatatatataatgtgtatatatattatatatataatgtgtatatatattatatatataatgtgtatatatattatatatataatgtgtatatatatatattatatatatggtataaggaggtaattaatagagaaagtttaagcatgagtgtggtcttggagccatcttttctgggttggaatgccaattctgctagcttttactagctggaaaacgctgggcaagttacttaaacattattttcccacctgcaaaaagattgccttgttgagtaagatattggatgtttctaaagccattgctatgcctgagacagaatgacaagcatgccaccacagctgtacctggctcctgacacctgtgtatggctgatgtgtcacatctgtcctccaacagttttattctactggattcttaaggtaaggcacagtcttgctgtggtgttagttgtggaatgaagtatttgtttgctttaagaattatatcagaaatgggtgaattctagaattaattaaggatgcctgaaataaatatatatttatatattttccccacatttttaacatctatgaaataatagatgaatgtcagagtataattatcattttcataatagtacataaagtattacaataataatttttacaacagattacagggcaacattttctaaggaagatgtatagaaaataaagcaaaaaagaacaaaggcaaaaaacaaacacacaaacaaaaaaacccatggaataaaaacctgtttgactgatttgactgttagtctgtgggtctgttagtctttaggtctccagtgtctcccaaacaagaatcaggctgcaaagctatgtggtgcttcaacacccaaatggcctccctggcccaagggaatgatggaaaaggaagaccctctcacaggacagagaatagacacttctgacagtaagatgaattacagccctgttgggcaattgctcctcacacaacagaagccatttgctgctgagacatgagacttgttctaggccagaggtccaaaaaggacagtgttgagcagcttaaatgaagagagcaacatgtttttttttctcaatacaattctctatgggttttactatcttcccacatttagtattgtagaagagaagcctaatgctaatttattaatttgttttcttggcagttaattgtgctttctgttctcatattatatacatttttacatcggttctccttattttggaaaaatcagaaattttactaaggtatgtctggatgtcaatctttttatattatttgttttcctcttcaagaactttcttcagattgagaatatcttttctatgaatgctatgactgtaactgttggttgtctttccttctagttaggtacaagcacacccacacacatacacacatgtgcacacaggcacaggcacacacatatgaacccagacacattcacacagatgagctttttatcctctgggatctatagcttatatcaatagcttgtagtttttcactttgtcgttatctgttaatactttgtcctttaagcaggagaaactttcctccaaacaataaattccatttccttcctgttcagtatcattgattccagcatttgaaattttaataatcatattttccatctgaaagcagtcatttgtcatttctgattgttctgatgttctcattaaattgccacttttattcctttaatctgctaaagaatatgaatatgaaataaaggtttttggaatattctttttttctcatggaatgtgtccacaatttaatacagtaatatttagggtgacccataacttctcacaatgttttttttttttttttgcaaattttgtatattaagagctagttatctgtggtcatttttgtccagtcataggatttaagttttttttaaatttcctgaggttacaaaagatgctttaaaagtgtattttccttataatgcagccataaaaaagaatgagatcatgtcctttgcagggacatgaatgaagctggagttcattgtgcttagcaaagtaacacaggaaaagaaaaccaaataccacatgttctcacttataagtgggagctaaatgatgagaacaccatggacatatagaggggaacaacgcacactggggccttttggaagttggagggtggaggagggagagaatcaggaaaaagaattactgtactaggcttaatacctaggtgatgaaattatctgtacaacaaacactcatcaaataagtttacctacagaacaaacctgaacttgtagctctgaacttaaaataaaagttttgaagtatttttaaaaagaaacacacaaaaaacaaaataaaacaaaataatataaaataaaatgtgtattcctgagttaggggttcagttgagtctgaagtgggcttttgtgtcacagcagcacccatgtttctttctacttcatgaattcagctgcagcagccagcagcaggtcatggttgttcatctccggccaggattgttttgtttgctaggaggcagaatgatgaaaaacataagagaaaaacgcatgcttatatctgtttatataatcagtttgttatcagtttgtggactaaagaccaatttgtcatgttcctggacagagtatattccacttttacaagcttccacacagagtcttcaaacttttctcaagaaagccatgagctttttgaaggcagagatggtatctactctagtgttgaggcaggaaatttacacttgtgttcagtttttaggactggttgtaggaatgaaagaatgaatgaagatgcaagccaaacagtcgatgggtgagttctcctgtaaccactgagctgtgagagtcctgctgtccctagactgccttactgtgtcccctccctgggagagctgtggtgggtgtactctgcaccaattttgtgctatgctgggagggcatctcagggaatggtaggtgtgtggtacccgaggagatacacatgtggtctctttttatccacgtcttacatatctctgatgctgcacttcatctctccttggaactctctccatctctattttctctgcctcccttttctctgtccaggtggctcgaagctcaaaggatggagaaatcatcagatcagtggatacgataatttgtttaaattccaactttgtaaatcaggggttatgtgactttggccaggttgttcacttctattctgagttccagtttctttatatacaggacccagcactgaaacagatgaactttcaggtatttttgagtttctttagtcaattctcggtctcagttcgtgcccaccggtcagtttcccagctactgttagcttccaggtgggcaccccactgcctctccccacttttcttccaccactctctagagaagcccatgctgctggctctctccttagaagtaattgcatttctatactgccttgagacgcagataacaatcccttttctaggtaagacaattggggttcagggaggtaaacccactaggaaaagtgacatcgcagttaactatcggaaccagaatttgattttaggccaatctgaaaccatgatctcttgcccttttgtattttattttgctcaaaataaaaattcagaaaggatggatcaaacatggattttattaatttagaagttaattcacagttccacattgttattttctccttatgtgttgggcactacgcagagaacgcagactgccttggtatgagtaaataaaagggcatttcagtgctagctgatgctggccgctagaccctggtttggagttgaagaagagtgatcactcttagctttccacacagaggtaaatgggcaatgccctggcctcctgtggcgtctgcagcagtgccgagtctaacttgcaggtcagtggtcagtgatggaaaaggactcctgcttgcttgatgtcagagctaccacatgagagaggctgcacaaattctgacatcaaactgccttgggagaatgtacatgggactaagtgggtgtgggcttgaccccactcttaagtcattgactaattcttttcattagtcacactacactttctaaatctaaccacaacatttagaaacaacatttgtttggaaattcaacatgctgcaccagaaccaagtttgatcatattgcttgtgactcagggtctaaagactgcaacaaacttagcaaagatgtggttggtatccaaagggaaaagctcctcattttaaggtaacatctgcttgaagggcttggtgccccagagggtactttaccagaaggccattaaagatacaaatggtctctaaactccaacttattttatgtttcaattcagcaagccagagtcatcaatttttttttctttttttctttttctttgtctattcaacaacgctagtcacggaggcaggtaaacatgaaattggcagatgataaactctgaaaactaaacccatatagtaaagccaaattaaaacatttgaaaatgtttttattcttgtgtgttggttcattcaaaatagagacttcttttttgatttttaaatagatactagtttcattcccatgacagttttgttaaatataaagaatattttcttgtacatcttccacaggacaataaacaaattgaagtgcaaagtcattctgagaagggaaatttcaaaatacattttaggatccaggatcttttgcactgcatgtgaattagctatttttagcctaaacataagacttatatttagaggctgaaatcagctgatatagccttatttatggtctgacccaactgagagatgaaatccgctgtgatcatggactcagacacataaattcaaacttagtctctaaatataaggggctcctgatgactacaggtgacatttgctggagttttcagacttaacaaaagagtgtccctttttgaatgttttagattacatttttttaaaattgaatttttttaattcagcagctaaatttcatttaaaatgattttatatcttgtcctgattactaatgggggcttagaaatcatactgaaaacttcattaagttcctcattcatatttcagtaaaagttgcctcaattgactttcatatatattttgcaaacttagattaattttatcagaacatctttggtaaaaattattgatatgcttttatttctttggaaaatataatgtattagccaacctactgtggtaaaatcaactgtgtttttctcagtagagggacagtccattcttttctttattcttataagcaggggagatcagatacttccccagccacaacgattcagaattactcatttgaatggaggatataatctcaaacttctttctgaagctagtaaatatcatcctagtctaaattagttctgtctagagataattcaacaaatgacgtttcttataactggatttcaccttcttttctagtgaaagtgccttttaaaatgtatggagtagtgaaatgagcagatcaaggaatttaaagacatagggaaaataagaaagtggtaagaatttaccaaagccatgagctcactgtctttttcttgacatgtttgattagtttgtggaactgaataccttcacaacttagagtaataggaaaactacctctccacttttgttgttgttgttgtttgtttgttctcagaatttggcttcattttgtaggagagaaataatgcggagccattttgagacagaagtaggagatctgtcaagtcaatactgcattacagtttggtccgttgaagaagccatgcctgagatataaaagatgcttctacactttacccgctttatgtttacttcctctccccttttctttcatcaactttattgggttaaaacaccacataccgctttctctaaatgactccctgtgtctggagtttggttagaattttatgtcctaaaccaaacttgtggctatactactcgtgccctgccataatacctgacataatacaaaatataaagtcataggaaaaacttctggatgccatcccaaaccatgacatattcaatttagaatctcctgaatgtcaagatgacagatggcacacaatctgtatggatccagctcttgagcagcagaagcacataattgcaaagcctacgctgattaaaagatacaaacactatttcaagttgtctgtatcagaatcacaatgtttgtttaaagctgatccttcactagaaaaaaaagccagtttggttaaattgaagagaatgtggtaacctgtcaattctgaatagccactccatgaaaacgagttaatacatgttagaaagatgaaggggaggagtatttactgacacagcactcttcaatctctccattttgattacaaaagcaggccttacaatattgatttcacataatatgcattatttgccaaattttaaatttgtcctaattagataataacatgtactggtgttagtctttcccatagatgtcatttttcttgcgcttcatttcctcaaagtcaaactcgaatcctgtaatcttcttatagatgtttttaatgtcatcacaattgtctcaaagtgagtggtagggttgtatgcacgggaaataaagatctggctttctgttcccaagtctttcggtaccaggaggccactgatactaacaaattcccatctagttggctccaagagctccaaagatgatatgacttccttctcaggctccttggtttccacagttgtggtaactatggcaatatacttctcttgtgttgctacattgtgcgcagaggagatcgtgcaaacacagatatctgactttctactgacttggttctgtggaataatgatctggcaggagttgacatcactggtgttcttgatggagtggctgaggatgcaaataactctgatgacctggcccactttttctagctgatcttttacatagctagggtcacagatgagctgcttacagtgagcaatttctccttcggattttataccaattacttttccatcctgcacaatgatttcttcaattggcttattcagcatataggtacctccataaatagcacttagccttgcaaacagccttgtggcagttctccaaggccatagagtggataaaggtatggacttttgacgtatcttgccaaagattcactgtcatgtttaattctattaatggtttcacaacatggttgatctaagtagtcatcagttctgtaaagtgcaagagcatgaccagtaaaatctataacatcttggcccaaatcaaatttcttatacacctctcacattgtggtcttcttaggatcaattccctctaaagttctcggatctttttcatctaagttggcaacataaactaggaatttcctgaagtgacgtttcttaaacagtcctattaagctagatgtcagggcttctgtttcagtggaaggaaccttgtagatttgtccacacttatagacaaagctcccttcagtcgctaaaatccagatagtgagttatctctgtataaagcagcatttaaccagctgaccattagccacaaggaacttgggaatcaagtcaacattccagtctcttcctctccccattgatggttatggtggtcctggtattttaaatattttgtatacatcttccagtagtgttatagaggcactctctcctccattgtaagggtttcaatccatatgaagaactttcttgcccttcactgatgttacacctgaaaggatacattccatcaggccaatgcccagcacaatcacatcatactcctcattcatggtgggtggggcaggtgtgtatgcaggacccaagaaaggaaaaggcgcacggactctgtgacctccctacgaggctgtgaggtgctctctggcacaagggaaaagggaagagtactctccacttttttttttcttttctttttttttttttctgaaatggagtctcactatgtcagccaggctagagtgcagtggcgcgatttcagctcattgcaacctctgcttcctgggttcaagcaattctcctgcctcagcctcccaagtagctgggactacaggcttgcgccactatgcccagctaatttttgtatttttagcagagatggagtttcaccatgttggccaggatggtctcgatctcttgacctcgtgatccacctgcctcagcatcccaaagtgttgggattacaggcgtgagctaccatgcccactcctctccactttttaaggaaatattatttctagtgaagtttacactggatcttcaattttatgaaaaccatctaatttaaaaatatcattttcaatactttttctttgacttcattttcctaagtatgtatttcccctgcttgaatatggcttaaatatattattttatttccatagtttgaaggatattggatttaacattatcaacatgtaaatcactgctctgccacttactcagttgagtaaaatgggaataataatgtctaccatgtgaaactgcaaaaagggttactgatatgatgtacgggagatccctagcacacacagtatctggtggacagctgtctttcataactatgtgttaaactggaaaatcaagtcaagtaatctttgatttatttttacaaagaatatgaaacaagatagcataattaatgatagagacagggcttcaacccagcccctctgttgtttcaaccaccttttcaggcccataggtacaaagctaaaaaataaaatacaagtaaataaaacagataacacacaaacatttttttccttattcttaaaacatatttctctttggctgcacattcattctgatgcaagtttctctgtagagagttgttgtccagcgtttattgtgtgtatggctggttaaaaatgaatgtaaaattctcagctcttgcaaaccaactgcaaagacaaagaatgacagccaaatggggtagataggtgtcccaagaaagcatctcacagaatcattaaccaatatgccctgcagtatcagaatctattgatgttggttctacgctgagctctactgccatttgctatttattttgacaagaagtgaaaccatcaggaatgtgctgattcattgcccctttgataggagatcatggggcacaggggacagtttggtgagtaggcttcacactgtgctgtgtttttcccagaaggtttggtttatcattaagaagcagggaaatgtggcagaaaaacaaaaacaaaaacaaaaacaaaaacaaaacaaaaaccatggccttgattatatgacactttttttctttttctttttctttctttttttgagacggagtctctctctgtcccccgggctggagtgcagtggcgcgatctcgactcactgcaagctccgcctctcgggttcacgccattctcctgcctcaacctcccgagtagctgggactacaggtgcccatcaccacgcccagctatttttttgcatttttagtagaaatggagtttcactgtgttagccaggatggtctcgatctcctgacctcgtgatccacccgcctcagcctcccaaagtgctgggattacagacgtgagccaccgcgcctggcccgaatacgtttgttcttaatcattgccataatctccaatttctgccttccttaccattataagcataatcatgataaaatattatcttttcctagaccaatagcgtccttctgacttcttttcctttctccagagtccagataaactgcctcggttcccttgtcttcttaccctctgcctaaggcatcctaggaatgtttatcttggctctacctttatcctgtacttctgctttcctgtaaggagactagtcctacctgtgaagcaccatttttcattctcagtacattgttgactatgcatatcaaagaactatatgataaagtacaccatgattttattactagtatggtttctgattgtgttctagccacacatcattagtcctgctattaagaaaactagtaccattcatttccaagacaaataggtgtccctacctaaggcattgagagataaggccatgcatattcataaggaaaattttctgctcccaaagatttaactgatttttctctttaagcttctatagtaaaaataaccagaagttcagggaataagatcaagcccagaatcacatcattcctgactgtgaaaaacagatctttggtatctatataacccaagaacatggcatggtttcatacgtgaactgagaatattaatatttatatagtagtcataaaaacaaaatgatatcacttgcatataattcgatgatgttcaacactgtgtcttgcatatggtaggtgcttagggcacagttttctttcccctaagatagtgcatctcaagtgatgtttgtttcataaaattggagaagggaatttaagtcattttattgtttcatatatgaagtatttgagctttgtgttccaaatacgtcattggtaagacctatcctttgtgcaaggaaccctgaaagattaacttaagaggaccttactttagcaatgaattcccatagacagatggcacctctgatggatcactgtatatgccactaagtcccactttggtcaggagagttcattacagaaggctcactctcacccattctgctgtttgctgcacattcagacttctaagattattcaatgctttctcattttaattaaagtaatttcatccaaatgaagccatatagtatgtccaattttacaatgtgctgatattttgcaactacatgcaacatttgtgtttatattacatttgtacacctatttctttgtgttttgattgcaaattaaaaggtgagcttggaaagatgacattaaattttggtaatgaatatatgcagttatatcaagttcagctagttcatcttataaataaagtacttttaagcagaaatccagacaatctttcatgggagcatttcagaggtaaatgttagtccctctctgcacctctgcctccttccgtctccagcatgcagcccccaggcagctgtcctgacagatgtctactccacaagggctaggctggactttgggcataaaataacttaaaagagggtacagctagaccctagctgttctccaaatcaaagtttcaccaaaagcaggtattggattaggagatatgagaactattttccacccctaagccaaaactgcccattttagaatgttatcacttctgtatataagtcgctatagacttttctagctagcactttctgtggctacttaatgaaaacacccaagggacccagaaagttattctttattgttccttaaaactaggggatgatgggaagggtatttaagctcctcagagaaaacaaatggacagtgctgctgtctctccttcccacccccacccccaaatccctttaatttttttctttctgtgaaccaggtcacatgatgatcaactctgtggttggaagtcaggaatcttcaaaggagtgggatgattctgcaagaactcccacattcttagtgattgcacagtacagtctgatcaaccctcctgaagaggacagctgcttcatctcgataaacccatcgtcataaatcacacgatggaatattacacagcaatgacaaggaatgaacaacgggccataaaaccacatgagtaaagttcaaaaacattctgtggagttgaaaagtacatggtgtaggagtcaatttatgaaattcaagaacatgtagagcatggtatgacagaagtcagcataatgaatacttctgctgtgaagattgactggggaaaaggatggaaagactttctgagtgacagaaacagtttgtatctttatctcattgaaagtcagacagctaaaaattgacctggatgcacacttcagatttccacattgcactgtatttacataacacttcaatttttaaaggcaaaggaaagaagatggtgacccctgtggtagtagtggatgtctctcagtggtctgaattctagagattttcctggcattaggaaaaaaatgcaggatttttaacacatacggccaagagaagttgaaaaacatagctaaaatgcgcttaaaaacaaaacaaaactaaacattagcataggttttgtacatcctagttcctctccctctccttctctttctctcttttgttcaaatgctggaagtgaacaacaattgttttgataataaaataactacacagtgtcaacaatgtttccttcattgagttttgaggctacagcaatgacaagaaaaaatggactttcatgttaagaatctcaccatctaaaagggagttatagcatcttttataatattaagttgcatttgctgactgctatctatttacactcaactatacacttacaaggttctacctgcttttttgtattaactattttaacactcacaaccaacattgaaggaatgaaatatcttgcctcaaatcaaagaattaataaatggtaaaggcaatatttgaagcagacagtgtatttctggagactattctctcacccactacatgctattaacatttaaccatgctatgagataaacaaagaagttctctcctagtttgacttctgtggcatctgtttcttttctttttttttttttttaacctttccccttctcttctctactttttactttcctctcctgattcactttcatctgcctgcctgttgaatatcaatgttccacagtttatttcctcggccttagtttcttcaaattctggaattccatccagaaagaaacatcatttattgccagtttcagtcaccatatgtctttctttctggggaactcatctacctgcatttccagaggcaatttcaacttatctggtctgtcatttaactctatatctttcttccaaagcttgtttctcctaccatgaaagttggaccttccactcaacttgaagtcttgtcagcacctttgaccagctttacacccttatcctccacaacaaatgcacagtgacctcctgtctctcatacccttcccctccactccactaacattaccttggctcagctctcatctcttacctgaattgtaacatcccccagtttcacccatccaaatacatttccacactgtggagaacacacaggaagctttctaaatttcaaatgtgttcactctactcccttgctttgaaacctacatttcccacaggataaagtccacattttatggcatgaaaacctttgccatcgtgcccagatgttaatggtggaagtgccagcctaggcaaacctaggcaggtgcactaggttggaaaccgtgtcagaagcaatgtaggaatgaggattaaagccacaggtaaagtcaggtcagaggtctttggaaagtctttatgaaaatggatgaggtgtgggcttggtactgatactttgaaatgtttacttgcatcgttcgttcatcattctcaggaaaagcagcaacctgcagctgggttctaaataagatttccagttttgtccattccatcccagatgcacccaggtgctctcttccttcagaggaaagaaatatctagtccatcaatcactgccccccttccaatattttagggtatgccctattttcccattagttcttggtttaggctacttctttcccctgcccttggcttcctttctgtcgggagaattggctcaccaaattccacttttcctactgtgattttattataaagatagaaaaagctaagtgttcatgttcccagccttcagtgtagcttctgacggtcacgtaacataaatgtgctcagtccagcattcacagaactctgctgctgcctctctttctattccttcttcctgcttggaatgcagatgtgatgttagaattggatcagagaaactgtgactctggggccatgaacccacccacttcactcagagttatgggaagcttaatgtgaatgtgctacatcgaccctggctcagctgcctctgggctccctgggaagtgagggaaatacagccatatttgttaaggggaaagttggagtcgctctcggctccacacagctgaaagcattattaactgatacagcctttttcattcataaattataaggaaggcataattgtccttacttcacagacatctcatagaatagaaaagctaactaagctggtttatcttggaacaagattggaaacttgttatctgaaactaaagaggtcattttccactctaaggtcagtcccagtgcaaagaccagcagttgtttttgttctctcttttggagataaggaaattgtggcacacagaagctttgagtcttgcaagtaccataaaccatgttctttctctgcctctcttctgaatctacttccttgccgtaccattctactcaacacagccaatcagaataaagtctttgtcactcttttaagtcaagaatctaccttagatatcagtgggaatattttattaaaaatacagcactaacagttatagattttatctatctttgaggattcttttgtgtattatttctaaggtatcaaagaataatgggccatttccctaaaggatatttagtatttattctactgtaaaaattgctaacactgttattaaatatatcagaaaatgtttccctgtttgaccactgtttttgaattgtggccatagaatcattaattagtttttaggtactcaatattttataatctgttcactgagcatgataaagtaattaaaatgaattagactgagaagctacagagcaacagatgttaataccgattgtaaatgactgaaagaagctgaggagcaagctgaggaattaaagatgattctttgatatgcatttaggatatgacacttctataacctcattgaaggggattccactcctttatgcaaacgtgtcattaagaagagaccccctggtctctggaagcctccaagatctcaatacttctctgcatccacatttattttcctttttttactctagtattcctgtctctgtgacatcctattgtttcccaatttaatttccatcttgaatactatttcctgatttgatctctcatctctgctgccaatcccctggattcatgactgcagctcatgcaaaagctctcatctcttacctggaattagaagaggcacccaagctcctgctgggatcagagggtgggccttctgttacatattggagactagaacaagcaaggatcttgccctatgctgacagagatcacatttatttttaaattttgtgtctgtatgtttgtgattccattttattcccatttcttttaggagatatctgctagccatgaattcacttagttttctttgactgagaaagccttcattatttctttttcacttttgcagaatatttttgctctatatatgacagatttttgtgtttatctttctgttttatctttctacactttaagtataccatgccattgtctctttgcttgcataatttatgatgagaagtctgctgtaattcttatccttgttcctctgtgaccagcatgatttttttttcccactttctttggagatttgctttttgccctggcttcaggggagtttgaataggatatggggtgtgtgtttgtgagtgtgagtgtgtgtgtgtgtgtgtgtgtgtgtgtgtgtgtgtgtgtgttttcagtattaattctgttttttttcctctaaactccttaggcctgtagttttgtttattggttttagaaaattctcagtcattatttcttcaattttttttatactcccttctccttttcttattctcagaatgcaactatgcatatgttacactatttgattgtgtcccacagtgttgggatgttctattagtgttctggttttgtttttcattttttttctctttgcttccagtttagtaagtttctataaacctatgtttaagtttactgattctttcctcagccatgtccagtctactaatgagtccatcaaaggaatttgtcatttccattgctatatttttatttccagtatttcaatttgattttttcttataatttccatctctctattcaaattatccacctggcactgagtgttgtcattttgtctagcatttccattgaagccgttaacatgttaagcagagttttctttttcaaattccttgtctgataattccagcctctgtgtcatggctctgtctagttctaacaattgctttgtcacttaatgactttttttcttgctttttaatattccttataattttttggttatagctagacatgaaaagaacagcagatattagataaattttatatgttgggagaaaagcacaagtttccttgtgtgaggccttaaatgtggagatggatgttcatctggtcagaagacaagctgcatctgaaactgtttgtgccatgggcaccagcgctttctggccactccattggtgcccttttttggctcccacttgactgagtctccccatgtgcctcttcacagttgtattccactgctacttttactgctgttttttacagtggtggtggtcctggctaagaagaaggttatctgatgttcacatttagctaaagattttggcacgtatcaaaacctaagtcctggacatgtagccttcacagctattcctgtcccttttcctgggataaaaattcttcctcatcttattgctcctcttctttttcccaaattgcagtggttttgaagccttttctcctgcagattgagactttggttgcttaggggaaactgggattatgcttctggttggagatttggtggtgatctctatttccatctttcagtttaataaattaaaacagtgtctcagggttaactttgataattttccctccagattaagccttttatccatgaagtacatagttggaaatagtctgggtagatttggcagtggctgcttcttccaccaaccccagccagcactacagtgtgtgtggggaaaggagtgagggatgaactttttctaggttcttctttgttcccctttgtaaatgttgggtgagttcctggacaaaaagctcacaagagagtggaactctctcctaggaatacagcctttggaagcttcacattctcacactagcccacccgcagcctccaaaagttctatacaatttttaatttttgattggcttatataatatacagtggctcctgtttcagatgagaaaatgctggagccttctctccagatgtcgggatgtcacttttccctatgatatagtttggatgtttgaccccttaaattttcaagttgaaatgtgatctccagttttgaagtggggtttagtgaggacagtttgggtcatggaagcagatccttaatggatggcttggtgctgtcatcacaataatgagcgagttctcactttagtagttcatgtgagatctgtttgtttaaaagggactggaacctcccgtattctctctctctctctttttttttttttttttgttgttgttgttgagacagagttttgctcttgttgcccaggctggagtacaatggtatgatctcagctcactgcaacttctgtctccctggttcaagtgattctcctgcctcagtctcccaagtagctgagattacaggcatgcaccaccatgctaggcagggtggctcacgcctgtaatcccagcactttgggaggctgaggggggcagatcccttaggtcaggagtttgagaccagcctgacaaacatggtgaaaccttgcctctactaaaaacacaaaattagccccttctctcttgtgccctctcttgacacatgacaatggctccccttcaccttctgtcatgattgtaagcttcctgaggccctcatcagaagcagatcaccacacttcccatgcagcctgcagaagtatgagccaaaatataccaactaactttataaattactcagtctcaagtattccttcatagcaatgcagactaacaaatgctacaacctcagttttctgatgggtccaagaaaagtcattgattttcattttgctcagatctcttgttgctgtggggcagatataacgacttcccaggtctttacatgtctgagctgaaactggagtccttatatcagtggtaaaaataaatactctacttaatgttattccattttacattcaatgtaatcaaggaaattaaattcttatacaaggagcctgaccgtgttcccattggaaagagttttatctagtaatttcactctacgtaggtgattaaatcacatggggacaaagtgagtgggcttatgctgcacagtgaattagtaaaagagcttcagatgagctggatttacatggactattcctataacttacagcttggacacttttaggccgaacaaagactacaactcatattccgctttcaagttgttatattttccacaaatcatttaccatttaaataatcatctgcatataaaattgtttactttagccctctcaaaatagataatttgaagctaaaatacgaattgtcatcctctgtaatttagagagcattttatatgacaattaaatgctgagcatggttagatgcttttgagaatacactgtaccatcctggtggcttatgagctttaggggagaatgacgcataaatatgagagaatatcaagaactaagagattcatagaagtgctaagtgcaggcccattatggaacatatcagcttacaggccagacactgaaataatgggattatgataggtaagagtgtccagtccaggccaggttattttagaggaatcatgagaagagcccactctgtcctggagcctacatggatggaatttttctgaaacatttcaaataaaagtaaaataagcaatctatcaattgccattaagtaacagaaaatttctttatattttccaaaagtatatcattagagctggaatttagtaggtgacctataatactggtgtttctggtcagctatcctggccaacccgcagtctgcttttctaacatgtaacattagcagagaccatcatttatccggatctgtgaagcctcccagaagagcctgcaaggtgaacagcagccaaaaatcagtgctgtggaaaaatgtgagcttctacctcacatgcctcctttcctgtttcctgcagtgttcagagatggctactcaaggtcatggttaccctcacacacagattctgaaggctactcttggctacaattcaggtaatgtccaacagggcaaagtgagagactagtttcttgtcaataatgataatcttttttaatacctaacaccaaaacagcaatcaataccatattggacttactcactcgctgggaatgttcagctagctaaagaggggtctggaatgaagattcagaacagtttcaggaacatatttattggagtggcattcaaattataaaacattgtaagtatttggaggagaaaacttcaagttgtgtgtgtgtgtgcgtgtgtgtgtgtgtgtgtattggaattgagggaatattagaaattcctaacttagtaattaagcttcttaagttattttcactgaaaaaggaaatctcagccttataattttcagcagatctaacccctaatttaaattctttgtctacttttcttcattttttttttgatgaatggcagccaaatcaatagcactcaagctaatctcactggttatgttcttaaaggaaatatatacccagaatacttgccaggcgtggcctaaacagctactatatgcatattatttccagattcttaatgtgtccctagcccagagaaaggcctactttagccttgttacagcttatatcaaggcccagtctcagaaatatttcttcatctcagaaatactttcatgactctgattctatgaggaaagacatcatgcaacattcagccattgtcaatatcacttttttctctttttcttgaacttacgcaatgatgttcataaatatccattttcaatgtatctattgatccatgaatacatttctgaaaggtcatagaaacttgacactaacttctaaggctttagaactttcttctttgcaaagaaccaaatcttgtttatttttcattcacattagatagtataacacagtcacatgaaataaagcaaaatgagatgaaaaacagtgtgctagttactatcattctatcatttaatactcaacataactctagcacgtaggctatgctatttataatttcaaaatgaggagacaatttcaagtagatgtagtacattgaagtcacatggtaaagagcagaggatttgggatttatatgaagatctgttagccttagagcagggtattcaaattttgccttccctgggccacattataagaagaagaattgtcttgggccacatataaaatatattaatcatagctaatgagctttaaaaaaattgcaaaaaatgtcataatgttttaagaaatttatgaatctgtgttgggccgcattcaaagctgtcctggcccacatgtggcccgcgggttgtaggttggacaagcttgccttagagcctacgtatgtgaagtaaattatattccattaaaatcttaaaggagtttatcataactaccaggaaaaatatttctaaagaatcatattttcatagataaaacacttagtgccatagcaagacctgctcatgatgactggacacttcagaggcaaaggaaacaagccttggtgtagccttgtgccctttcagagtgagcctttccaccctcttctgatggaaaaacttccactcaagcttaacatctcactaaagcattacctttcccctgaagacagacaggtggtggctctttcctccatgtcctcaggattaggactgcttgtagaatatttctgcacccccaacacctagctcagacactagaacacaaaagaaatgtgataagtatgtgaaagaagaaaaaaggtgagatgctgatcactgcaagccttgacaacagtagccatatgccatgacatccatttgtcaacaatttattttcctattattttcttatttaaattccccctgtgttaatgagaagcacttcagttaagtgcttaataaacaagcaattacttaatagacattaatggcctgctgtattattgcctgtaacataaagggatagtgagaggtacaaataaaacccaacatttatacatcatcttaaggtattagagagtattttataatataggcattacttgttaagcaattgcgcactttgctaattgatttggggtgatggatgaaagattagcataaataacccatttttgaagtaaactaacattagcaaggaagacacatggcactggattttgactaatttgatcaagaaacggtcttcctttgttcatttatatataaatttgctaatttgcccaaactaagctcaagtctagaaaacagtacttcatagttgcaagtaaacctgagcggggccttcttatcgtaattgtttcattttgcttcacagctgagtgtcttttcttctactcaggtgaccagttaatcctgacagaagctcccagccctctgtaattcagccctgtcatccttgtgacgtggattacctttctggctacaaattgaatcatggtgcctcatcacagtgttgttctccaagcctggaaggtatcctctgaacagacagcatgccaacccatgtcacccttgcttcttccccccacctctcattaaggtattgcacagagattggactggaagtcagacagatgtgggctgaagccctggctcccctaactgtggaatggtgctgttttctcagtctctctggtcctcaacttctctttataaaatcggtggacagtgggagcatataataatctcaagtacttaaaaaagttttaacttcttctaagctcctagtaattgcttttatttctcttacaacattttaattttttatcaaaataacacatgtatggaattcaaaatggaaacaaaactaaaaaagcaaaaagactttttccattccacttttcccactgccaaggacagactctgatcaatcctcagaaagtctcaaattagactgtaacttggatagcaaacaatgaagaagcttaaaagaaagagaaaagtaaaaatataaggtaagttggtaatttaagaaatgcatataggaagtaatttatctcaaaatatattccaccattcagaagcagataatatacattttatcctagaaatgtaacataggatattgctctaatccaaaactaccctgggaaaatgaaaggaggtggtgagtgtgtgtgtgtgttcaacaatggtatcctcattttgcatagcagcaagtcaacagacaattcttaaaactgaaaaacagggccaggcgcagtggttcatgcccgtaatccaagcactttgggaagctgaggtgggtggatcacctgaggtgaggagttcaaaaccagcctgaccaacatggcaaaaccctgtctctactaaaaatacaaacattaattgggcatggtggtaggtgccggtaatctcagctactcgggagcctgaggcaggagaattgcttgaaaccaggaggcggaggttgcagtgagccgagatcatgccattgcactccagcctgagtgacacagcgagactgcatctcaaaaaaaaaacaaaacaaaaatctgaaaaacaagaaattatgacataagccaattgttttagaaatacaggtggacatcatactcaggagaaaaatgattaaagtgattgtccctagcaaactaatgtaaccacaaataaaaaagtaaaattacctagtttttcaaagctgtttatcacattacagcagctgtgcccaactggtctcctcttttctctcaaagtctttatgtttttgtgtctttgctgaattgtttaattctttgctgacgctttctagtttttgttttgttttgtttttttgctgtgtacagtcattcctctgtatccatgggtgattgattggttccaggacccctcttgaatatcaacatatgaggatgctcaagattctgataaaaaatagtgtagtatttgcatataacttatgcacatcttcctgtatactttaaatcatctctaggttacttagaatacctaatacaatgtaaatagttgttatactatactggtttcttatatgtattatttttatcgtattgctgtttattattttttaatatttttcatctgtggttggttgcttgttggagcattttcaattcacctgctttaaaatctttgttagataattttaatatttggttcaccttaaagttggtatatatggattatctttttttcattcaggttgagatatccaaatttcctttttgtatggggacccaagtcatataagatgatgggcccaacctactccagtattcttatacagtcacattctgaagttctgaggatcaagacttcaacacagaaatctgaaaggaggaacacaattcaattcctaacagcagtataaatggatcccctctttagtatgatttttagactttataggaaacattctcattatttctcagttatttttggcataatgaatgaagtttcttctgaatgtggcaagaagtgtgaaccacttggctgctcaagcacaaatggggatttgcagggagaagctggtgctgtggtctccattttcctaagaatggtgccaagaataaaaagcaatgaagggtttgtgataaaagagtaaatagtgtaaagatgttcaaacacttctaagtaataaatctgtattaaaatgaatatttgtatttccttaatttcattaataatgaaacaaatgaagaaaattacctatatgttgagttcatacaattttttaaaaaacacatattttgttttattttattttaaaacttacttgtatttatttatttttaaagacaaggtctcactatgttgcccaggatggtcttgaattcctgggctgaagtgattcttctacctcagtctctcagatggctgggactacaaacatgtgcctggcaaagatatacaatgttttctaccaattcttctctatcccttcttcctgatagaatacaagcttgaaggctagaagtgcgatggtcctcagctcatattaaattgacaaacattcctgaagtagtagtcataggcttagctcttagctaaaacaaaaaacaaaagcagaaacagcagcacatgcgtatgtgttatatttattaactgtgcagttttaaaaggtagaattttctaattagttgaaaaatttcttactatatcaacaatacaaatgtgtttagaattcatattatgtcattgttatcataattggacctcaggaatgtaaacagaaatgtatttgggagaggtgcatatcgctgctgaccctgttgggctattacattcttttagactagaaaatgtacaggtgacactaagccagtggcagagaaattggaagatttgtcgagtgctgtgaccctactcaattcttcataatttttctagcagctctcacattatttttaaaatttaaagtccagttttcactaccagataattttgattgacactggagtgacaatgtctgttttctcaatgacacctactagttcttactcattacttgtcactggcatgaagggcaagcaacttagttaaactgttcataggccttacaaagcttgtcttttatttttatatggaggggaaaaacaatcctggagtgaaaatatgccttaatttaaagacgaattaagtgtcataaacggctcataagcacaaacctcctgaattgttctgacgcaagaggagcaaataaaagaaccacatgaaatccccaccttaatcattttattttatgacaaatatcttgcttgaattcctgcattttcttatatgccaaataatttccagcttgaaaaataactagaagccataaaagcatttactgttgtattatttaataagtcattttacaactcttgtatttcccaaatccaatagccctaatttttttgtattttaagttatttaaacttcacagccatacaagcagatgtatcaggtaagcatgtgagatagtatgttgaatatattaccatacagtatttctttatgcagaattacacacggcaaattctcaggtgcagtgaccaaacaatcaaataagatgcaagtactctgggaaccaccaagtttggacagaggattgtaagctacaaagttaggaaatgtaggagaatatttactttacatagagggaacagaatgagtataagcgccaaagcaagtatagcttctgggaacgagcttatagctggagctcaaacgaaagggaagggagaaagccaggctgcagaggtgactccatgactgatgccatagtttctctttccccaggagcataaacaagcagctgtgaggagctggggataataatctcaccataaaattcagaggagattcgggattggatatgtatttagggaagagtaactaaaatagacaaaaaatgaggactagaatttaggatgggggaaagacttaaaagaataagactaagggaagaataagaggttttagaaagagataaagaatggaggcgacccattgaacaactgggtcacctaaaacacatccatctaaggcatccataatgttgatctgaaataaaagtctaaggcaaaattagcataagtaaagaatttgttttggccaaatttgaggagtgtaacccgggaaacacatatgcaaactacgtcagagaagtgctttcagctggggaggttacaagcagatttttaaggacaaaacgaagaggtataccaaggtggtctcagcctgttcatccagaaataccattggtcaacagaaaggagctaacagatgattggctaaaggctacagcacttcttggaatagtcattatcagtttgtgatgaacccagctcctggaattcttataagtaaaaaggtacaggaatttcaggggagtaactgtggcatcatgacaaccctgtttggtcattgtaatttagttatcctcatttgttgggttttgttttcaataagcatgaccagtgagaacctccccttttgtttgatccaaccttacagaatagcttacttttccacacagccttgactctgtaaagtttagacgatcttggagacaattagtagactgctctttaaaccttcctctagttgtctgtatatcccaccttatgcagaaatggtggtcaaaatggtagctaatttgggtgagaaaataaaactttctccatgcccaacaccctccacacacattggagttcaacagtaaaggtagaaggagcaaaagggattcaacaatgaaaaataaataacctctctgagaaaagtagagccctttactttcctcccacagagaagcggccatggacatatcttttcagatgtgtcaaaagagtctgttcctgtggctacctgaataacaaagacctaggcagaaatcattgagttgtagatacaaacactctcagactagccagacaattgcaggaggactggggaaggaagaataagatagtatctccggaacttaaggagaagatctcttgagaagcaaatgccaataactagagggaaaccacctcaggctgaaagggtagataacagtctccatcgtctctggtgccacgtggtcaatcattgttgtttctctctaggagtctgctttattactttttcttagaagcatggccttctcagcctacctttcacttatttcagatatggctacccagattaaattttacatgagcatttcactcggggaccgcaaagagaataaggaggggctctgggactcaagtttacctcatagaagaagggatctgagtggcccaacctggatgaagtgacttttctaatcagttgtctttaggatttttaaaattattataaacaggggtctaagtgttcatggatagtgtggtgactatacaagcaaattccaagagcaagactgtctcatatgaaaagtcgcatttcttagcaagaaccaggtctctagcaaagagcaaacattcagtaaattgtttctgaatctattaataaatgataagaaaaggcaagggaaatcaacatcctcactgcatgccttcagacgtgtgtttcctatcagatacgggtattccaacagaaactggagaaaagaaaatacaatgcattcactggacagaaatattgtggacggggggcaagcattgggacagtggtgagcaaaattattcttgaggtccccattaatcaaaatatttgtggcatccagaagcttgaatctttaaggacaaatatgaatctttacccatcttcttttactcttctctcctttctcctaaactaactctaatatatacatttacttttaaaatttcataaagcctatctaattgggaatttaggtctcactccttgtggacaccagaaggatataaatgattaggggaaatcccaccaaacagaaagggcaagaagatgtatgaatgagtagtaagctcaagaacaacccatcagtcctcttctttattttacccccaaaccaaaacttagggatgaagcttcacgaagctctcttttgtgaaggagagaggcctgttccgttgccaaggagtgcaaagctgcacattggctttgggatgacattgggtataaaatttatcacttgtgatatccctgtgtgatcttctacacacattgtttagcttctccaagacttttctttggaaagcccacatagaacagaaaaaagaaatgccatcttttaaactatctatttaactatcttgtggccccatgtttccaaggttggggtattgggagagttggtgaaagagcaatatgtcaacattaacttgtctccaagcaggcatgactttcaatatcaaatggtcacaacctccaacttttaatggatcctaaatgagtgcttcaaaaatactgtcatttggtaataaagtcatactcgaagtaacacttatttggctgaatttccagagactggagagaaggttaagatccaggtggttgctatgacaagagcatgatgacttattcatccaacactttgttgatgtcagtatgatatagcccttcagttcatggtttaaaaaagcaaagggagggcggttgcgggagggagcggggcaggcgctgtgggccaggcccctcctctggctcctgcaccaccgcctcttttcgggctccgccggctcccgccgtccctgcaatgccgctctgtgcccgccgtcctgagagcccgcgcggcactggcgccagccttggcggcgcgcgcggggccgtggtcgttgctccctgactggccgcggcggcctccaggaagcggaaaagcaaggggcggtcgagctgggccgccgcgccccactgctcgccgcgctgctctttgacctcgcagggtgtgaagaagatgcgcagctccacgctgcaggacccgcgccgccgggacccccaggacgacgtgtacgtggacatcaccgatcgccttcgttttgccattctctacagcagaccaaagagtgcatcaaatgtacattatttcagcatagataatgaactcgaatatgagaacttctccgaagactttggaccactcaatctggcaatggtttacagatattgttgcaagataaataagaaattaaagtccattacaatgttaaggaagaaaattgttcattttactggctctgatcagagaaaacaagcaaatgctgccttccttgttggatgctacatggttatatacttggggagaaccccagaagcagcatatagaatattaatctttggagatacaccctatattcctttcagagatgctgcctatggaagctgcaatttctacattacacttcttgactgttttcatgcagtaaagaaggcaatgcagtatggcttccttaatttcaactcatttaaccttgatgaatatgaacactatgaaaaagcagaaaacggagatttaaattggataataccagaccgatttattgccttctgtggacctcattcaagagccagacttgaaagtggttaccaccaacattctcccgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaaagatttctggatatctgtgaaaatgctgagggtgccattgcagtacattgtaaagctggccttggtcgcacaggcactctgatagcctgctacatcatgaagcattacaggatgacagcagccgagaccattgcgtgggtaaggatctgcagacctggcttggtgatcgggcctcagcagcagtttttggtgatgaagcaaacaagcctctggctggaaggggactattttcgtcagaggttaaaggggcaggagaatggacaacacagagcagccttctccaaacttctctctggtgttgatgacatttccataaatggggtcgagaatcaagaccagcaagaacccaaaccttacagtgatgacgacgaaatcaatggagtgacacaaggtgatagaagtcgggccctgaaaaggcgaagacaatcaaaaacaaacgatattcttctcccatctcccctggctgtgctgacctttacactgtgtagtgttgtcatctggtggattgtttgtgactacattcttcccatcctgctattctgactcaaagatttcagaacatagtagccatcaggaccccctgacagatagctgcttctctccatttcaaggactaaaatggttttgcattaagtaaaaacctgtgaccagaactgaaggaagactctaggaactgaaaactgcaacagaaattagcacaatttgaaaacaaaacaaaattgcaaaagacttagttgctttccacctaagaagctaatcaatggggaaaatgtccacggggtttcagtaatgaacttttgagtttgggtgcaagcaaatgtaccaagaccagctcagtcagggagaccctaccccagtggtgctagaggaattaaagacacacacacagaaatacagaggtgtaaagtgggaaatcaggggtctcacagccttcagagctgagagccccgaacagagatttacccacatattgattaacagcaaacaagtcattagcattgtttctatagatattaaattaactaaaagtatcccttatgggaaacgaagggatgggcctaattaaaggcataggttgggctagttaactgcggcaggagcacgtccttaaggcacagatggctcatgctattgtttgtggcttaagaatgcctttaagcagttttccactctgggctgggtgggccaggtgttccttgccctcattccggtaaacccacacccttccagcgtgggcattagggccattatgaacatgttacagtgctgcagagattttatttatggccagttttggggccagtttatggctggattttggggggcttgctcccaaaaagaatgactcaaagaaaggcccagctctcaagctgaatgacaaaaatgctgttgtaaatttagtctcaggtgtaaatacccaagccctctggtactcagggagctggctggtctgtggtgcatgtgtgtccttgtgatggcaagcattgtagttgatggccttcagaagaattgaggatctgatggaggttttttaatgtatttattttctgttcagcttgtgaccctgtgtcaaaatttgtaaagatacaaaaggcattactgaaatggtactttctgtaatttgatactatttggctttaccatcttcacttgactgtttgtaatactgtagtaatattaactctgataagtacccaagctgcttgtcttctaccaaagagtgctttattaacaagaatctgtgaaaaccacattttaaacactgttgcatgttgtaataccaggtgataccttggtaacctaaaacttgcaagagaatattagtggtagctttagaagactcaggaggagaaactgacttcagagctggaagatgttgcaagtcattcctttttctgtcctttagggactgaagaactgggaggttgcccattgtttggttgccagtcatacaaattaaaatcatatttccttccatgcatggaaaaaacacactattggtttttcgccttggaaacagcaatcccaaataatgtcggctttaaaaaaaaaaagttaccgcttttttagagtccttctctgtaatattggatttttttttccttatgagatcagcctaaggccattgataaggcctgtgatctcagtaacaatgatctgcttctgaatctcactgttgcctttggctagggaacacaactagtaactctgcagagtgccttctcccgcaaccctactggaacacagcagagtctgtgccatgaagaaattagagaaacagaattgtttcgctgctaaaaaaaaaaagggggggcccaaaataaaagaatatttagtactcacctcagttccttccataagaagtgggtggtttaatgattgttaacccatttttgcctgtgctgggagcatggagggctgagatgttgacaggcagtgggaaacaaatgccctcctaagtcacaaggcgtgcgccagatcaggaggcaactccattttaagaagctgcctttttcataaaactgtaagaaaccaaagcagttggaataaacaagttaaagtctttaatgcaaaaagtaattgaaaggcagtgcctccattttggtgtactttcttggaagaaagtacgaaattgaccggcatcatgagagacggaagatgccgtattctcagccaaacaagtgactctttccctgccaagcactatggggtggggtcaggctagcttttaaacactggggactggatcacagaaaaacagtggttttctgtccctggaaatgaataggcacaaagacccacttggctgtgggaagaccactcttcaataagattttggtgggaggaggaacattccttttgctattttaagctgagacaatacaaatatttaaactgtgccatgcataaagcattgaattctcagggcacttcttcttccccttaccctttttaaggccatccccttcataaataataatccaggtagttgtgaaaattgtgcttccatctgattccttcttagtttggcttttcatcccatcagaacaagtaaatgtgggtgccacagcttttgtgagtactgtctccctcacggtgaacaagcctcctggtgttttgtccgagaaagggaagggtgttggtggaaccacagtcctttttcattttataaactgcctcttcatgttgcctgctcaagtttccacctagaattgctatcactgtgactctttctaaaaatccttctgcttaactggttcactgaaattagtcatagaaaatttgtgatttggtgaagaaacattccttgtaataatcaaatgacttgggatggtgtgcatagcaacagtgttacacttacggggaccgtctctagacttatggggaccgtctctagaatccaagaagtctctgggtctgagggatggaaagttcttcctgctatgaatgagagtggactcttcccctcacccccaactaaaaccacaaacacccagaatcttctgggattagagtccttgttatagaagaccttgttgctatggaacatgaaactgtgtctgtcagatagattcccttaagagccttaaatagccctgaaagtacaccgggacagtttgcgatggaattaaaattagaagtgaatatttttaggtgcccttgaagctttctggggactcaaaattatcaagagtcaaggacagtctggaggaagagcatctgcaaaactgggttcctggaagtagggacggacgtggctttttgtagaacttggtggagagcagctcctcatgagagcagaatggcctggcgtggccagtgcttcccggcagcacgcgggtctgccggcctccagaatttccccgttctgagcttgatgcccctagcctattccctacctacttcctcccttcccctctagccctctcacaggggtgattgctacctctctcttttcttgggcctaggcaagttttcatgtgacaacttaactggatcatagggtgcctggatacttggtcaaacatcattctaggggtatctgtgagggcatttgtggatgtgattaacattggattcagtagactgagtagaacagattgcccttcctcgggtgggtgtacagcatcatctactcgggtgaagacctgaatagaacaaaaagttgaaggaaggatgaattcactctcctctttgcctgaaggcttgagctggaacattggtcttctgctgccttcagactggaaattacaacattgatgcccctgattcttgggcccttaaactcagactgggattatgcaactggttttcttgggtctccaacatgcagcgatcaaattacaggatttctcagcatccataatcacgtgagcctattccttatgataaatatcttcctatagattgtgtatatagatacagatatatgatatctgttatattctatctacatagtgtgaaagcatatgtatctttagatctatatctatatgtatgtatgtatgtatgtaggtaggtgtctatctatctatctaatctacctaccaatcatctattttattgattctgtttttctggagaaacttggctagtgaaatgcatccttaggcaattttatcattgtataaacatcatacagtgtactcacacagtcaaagatgggatagcctactacacacctaaactatatggtatagcctattgcttctaggccacaaacctgtacatcatgtactaaatatggtaggcaattgtaaaacaatggcgaatattggtttatctaaacttagaaaagttggtggaaggtggaagtatgacagataaaaaatgatacacttttatagggagcttatcatgaatggagcttacagaactgtaagttgccctgggtgagacagtgagtgagtgctaagcaaatgtgaaggcctagaacattaggatacactactgtagactttataatcactatacacttaggctacataaaatttattgaaaaatatttttctctgataaaaattaaccctagcttcctgtaactattttactttattgagacttagcttaaaacacattgtgcaactgtacaaaattatttcctttctttatatttttattctatatgctgttttctgtttttaaatcttaattttattatttactttttaaactttttgttaaaaactaagacagaaacacatacactagccaaggcccacacaggtcagcattgtcagtatcactgtcttccacctccacatcttgtcccactgggaggtcttccggggaaaataacatgcatggagctgtcatctcctgtgataacaatactttcttctggacacctcctgaaggacctgcctgaagatgttttacagttaactttttttttaagtagaagtacactttaaaacaataataaaagcataatatagtaaatacaaaaccagcaacatagtcatttgttacaattatcaagtattatgtactgtacttcattgtatctgctataattttatataactggccacatagtagatttctctacaccagcatgtccccaaatatgtgcgtaatgctttatgctacctcatagtgatatgacatcactaggcaataggagttattcagctgcattgtaatctcatgggaccgtcctcacacatgcggttcatctttgatgtgtggcatcattatgcagcacatgaccatagatggcaatactacttccaaatcacaccctgaattcttcctcttctccccattgcctcattgtgtcagcagtttttcctatcctcattcacctggatcacagcaatagccatctaaccagtttatttatttcctttcttgacttcctatactacagtatttatctccatcatagcctgggttatcatctataaatgaaaatcagttcaccactttttcacatttaaaaccattagaggcttcccatcagagcataaactctaccttcttgccacggcttgcacaggttcttcatggtctgccactggctactgcccccacttcattccacaccatccttgagctggccaccaagctcatccccagtgccttttgttatgtgtggacttttgtacttctgccagagggacttcacactaagaggtatttccagcctgatatactctttcctatgacattcacaccacagattgcttcttatcattcagatttcagaaacaactttccagatggtctcaaccaactgtcctgattctcttgtccactgcacagtaatcccggctcagcgtacatcactatttcctagttttcaaatgattaaatgaatttgttgatgtgttagtttatttgcttcctctttatctgactcatgaggatgtatattttctgagagaaagaagcaattattcaacactatttcttcagttccaggtacagaggagtgtctaatatagaataaccatcccaaagtatttgttgaactaagcaatgtgaaacatttatttaaatagtgtacatcgaatgaatttggtacaaatgcacaatttatatgtcaaatctaccttaattctttcctcattagtatgctgtaattaaaatacatacaaacgtaaggaattcaattatgtaacaatactgcattgtgtgatggttttcaatgctttatgatcttatctttctcagcttggatggctataacaaattaccataagctgggtggctgatataaaacaaaaactgatttctcacagttctggaggctgaaaagttcaaagtcaaggcagcagtaagcaggtttagtgtctggtgagtgtgtacttcctggtcatatatggtttcttttcacaatgtcctcagatggtggaaggggagctctctgggcctcctttatgaaggcactaatcccatctgtgagagctccaccttcatgacctaatcacttccaggaggccccacctccaaccaccatcatattggagattagattttttcataaaaatttttgggagataaaaacattcagtctcttattatcatccacaaaatgaaaacacagaataaaataattatcatgaggaactcacagctccctgaaacatatctatgggtttcagtttttgaatgtactagacaagcattgagtcagtctcctctgaatgtctggattcaaccgagtttctaaatgcaggatttttagattagtggtgactgaaggaactcctgatttcttccttgagaggcctggactgagcatagtaaatcttccctcctaatatctcaatagaatcatcgaagtacaaagctgctctcctgaagagtttgatagaattcagtacagttaataatttaactagctctcatgactggagtctggggctcctaactcataaacataaaggtatgtgccaataagttaatttcagataaaaaagatggatgagtctatgcttttttttctttgtttttattttattctaatctctgatgattcattactgtattagatatcattgctattgcatgagcaaaaaattctgtgtttccacagtaaatggaaaaggatgtataacctcattattgatataatgccattaaattagttgaaatgcaatgatcacacagtgcctttggcaaggctgggcaccctcatgggaactgaaacttgatgtgaaatcaacatgttgtattagttaatgcacaatgtagtgacacatcataggtaaatggctaataggcagcagcaatagctgattgtccatataactgacccttgtctattataatttttaaaaatgatgtttttataaaagaaaagcaaattacaaagaacctgaaaaattaaggccccagactgttactttgaacaagtccttgacatcattctatcccactatattcttatactggtttaagaatttagagctaaaagttttgatatataaaacaatgataaatcaggctactatggtgtttttttaaaagacttgctattattttagctcagaagagacaaactcatggaatgatattttgttaacacaaactccctgtttgcttgagtttgcacttgttaaattttgactgagggctagtccacagaaagagctaaaaagagaaatctctcatagaatcgctgccaggcctataacaaaagccaccctactggttgtagctctaataataaactctcttttatacaggcctttcaaagttacagggtcacaaagtgccttgaaataaatttcaaagggaacagcaaattctggaatcacacccaaactctttatgttcatgactgtaacagagttaataaattgtgggcataaatgaataactgcaatgtcctgcttggaaacccagtggtgagtgtgttcatcagataaaaatgaccaggtgttgacaggcaatagaaaggaattatgagcagcaggggtttagtatcgatacctcaggaatttaacttatgtgtcagaaacaaggctagggccctgggagaggaaggcgcagagatatatgtactttgcagactattactgcaaagcttggtataaagagaaacaggagaccaagctgattatcatattcatgagcttgtcaacaataattggccagatccttgttaaaatagaaacagtaagagtcttgaccgttcattttctgggattatctcctatgcaaagcctgagggagcccaactatctcctacttcacataaagatgattaattttcttccttgtctttttttcttcctcccatcagtattgagaaagaacaaataatttgaatggaagacttagcatattttggatccaagacagagactctgtagtctcagttcttttccacacctaaggggactgcagacatttgaaatttcatgaaggaaagtggagtggagcctctaccacatgttagcacctggttctcttaaaagggagacattttcttccctctttaaactcccaaagtatcccacttctttgagatctagcattttctactttgtgttagactttacataaatgtcatttttaactatatgttctctcctctggtcacctctaaccacctttaagagaaatctgtacactaatttctcatctcattgactagtattttgtatattgtacagtatcagtaaatattcctcattttctctatttttatctccatggtaagaaattccaagatatgctttgttagtttcctaatttgttattttttattagtcagcaaaggcttttttatgtctagcttactgtatatgtacttgctaaagtctatatttatttttgttaattcttcaaggcagtgaagaattcttctctgatttctactaacctataaatcacatatatgattttcatgtattggcatttacgaaattgcctttattgttagcacactgtaaaatctattgtaggtaaaatttaacttctcaaggcaacttggaatgatgttaatatgtcatatctctgattatgtcaataagtaactattgatttggaattaggtaccatttcctgctttactacagattcccttgacccaaagaaagattattagtcactaaagccaaaactttcatttaatgctaaaaattttgccaatattttaccaaattacaatcttgaatcttgaacataacacttccagggactggaggtcgaaatcatcctgttccatctatgggcatcttttctgacgtaaagtgcttcctgaactaaaagcaatatgtacttaacttttcttcagtggtctttgtcacagaccttgtagggaaaaaaaaaaaaaaaaaaggaaatatcttatccatagacagtcaaaactattttaaagtagttccattctctcactgaattttcctcatttagtgtagtttggagactattcactgatgtaaaccctgcctgctaactgggtttgtttgtgttgctgagagtgctctgcaagtaggccaacagtgccaggagtgggacagggcattttttgtgctgaagttatggtctctgtgaagctgaggttcacagtaggacttttttaaaattccactactctgttgaataatattgagcttacaactgaaaacctcgtttgtttgtttttaatctatgcatttattcattccttgaaatattggggcccctgtaaatacactggtgaattaggtcaacacagacctcgctctcacagatcttaaaatctagaaggcaaaaaatcaattaactcagtgatatttagttgcacaaaacataatatgataggagtagcgtggggacctggaactacagagaaggtgtgcatatcccagttaaaggccagttatgctgactcagaggactggggaagaactggaggcttgggtactggaaatggtggtctcctgcagaagttggtggtagagcagagagaagtgggatcagaaaatagatatttaggaggcagatttagcaggatttagtgattgatcatatgtggagcagtaaaggaaaggagaaatgcaagatgatgtcagatttgtgggttgggcacaaggctattcatggaaacaaggaaggagaggggagaggcaggattgggagagtagagaggcagcattgggtagtacctgaaatcacacttgaacagggtaatgaaaatagaagaggcctcaaacacagacacaatcaaaatagaaaggatgatcccaagttcaacattcaatgattccaacacattggctagaaatgcggaagaaaaagtctggtttcagggaaaccaaggggcgaggagtttaatacagaaggagagagtcaacaatgtcagaaagtacacaaaattcaaagataccaaagccttataaaattaatttcatccattgataagaaagctattcatgacttaaaaaaatgattttggtgaaatggtggaggcagaatataatatatctaaaggtcaggggaaagcaaagaagacaagaaagtgactttggcaacaaagtttagagatcagatcagattgagtagcagggcctgtgaggggaagggtatttttaagattaagagattgggatactgattaaaggggcctggcacaaaaggagatactaacagcctgtgagagaagaggaagtcagttgaattctcccaagggaaatgttctccataaagcttcttcttttaaaaaaaattaaacagctttgttgaagtataattttcatatcataaaattacctcactgtaagtgtgcaatttagttataatagtcatttatagagctgtgcaactatctctgaaattcagtttcagaacatttctgtaatctccaaatgttttctcatgcaggcttgcaggtcttccttgctcccatccccagcaaccaccaatctcctttttgtcttaacaaatgtggctgtgctaggcaatttatgtaaacggaatcatagaatatgtaccgtctgtgtctgtgttctctcacttagtataatgtttgtagactcatctgtgctctagcatgtattcttttatttactgaatagttttccatttagtggacatactacacttttatctatctcttcaactgttgatggatattcagattgttttcagttttaaggtgttactaataatgatgttgtgaaaatacatgcatattttcatacagacgtgttttcagttctgttggataaattcctgggagtctaattgctggttatatgataagtttatgtttcatgttttaagaaaatgccagcctgttttcagagtggctgtatcattttatattcccatcagcactgtataagtgttcttagtcctctatattttgtcaataattggtactgtctgtcttttaaaattatagctaatcttagtggatgttcaatgttacttcatcttgtttcaattttgtcttctaatgactaataatgttaagcatctatatgcttatttaccattcctatattttccatgatgaaatatctgttcaaattttgtgtccatttgtaattgaggtgtttgtttttattaaaagatatgagttatttgcaatccctttagtaaatacatgatttacagatttttattccagtttgtggcttgtctttcattttcttaatgatgtcttttgaaggacaaagttttaagttttttggttcaatttgtccatctgtcctttttagaaataatgtttttggtgttctatttacaaactttgtgctcaaaacaaagtaataaagatttttcttctgttttcttctaaaagtttaaaattttaacacttaaatttatttttataatgaatgttgaattaatttttgtatataatatgaggtagagatctatgtttattattttgttctggatattcaattgttctcacactatttatttgtgaaaaaacaaacaaacaaacaaaaaacactattctttacccattaaatttccttggaatctttgccaaaagccaaataaccataaaagttctctttatacttttttaaaataattattaaaactaattgcagcatgtaacactgattactgctaaattttatcaaaattgattcagttgtttaagaattaaaagttgaacaaattagaaataaagctttttgaaaatacttggaataaaatattaacaaattttaaggacacatttatcttcaaaaatgaataaagtatatatgggggattttgaagtacacagaaaagctttccaatgataaattatccatagatattgttataccattacagtaagtataaacttgaaatatgttcttagacagaaatctcaggaagctaacaaaggttggggaacagaatattccccttaaaaacaataagtcaagtccacacagaaagtaaagcagttaagtccaggtgcggtggctcacgcctgtaatgccagcatttgggaggccgaaacgggtgggtcacttgaggtcaggagtttgagagacaacatggtgaaaccctatctctacaaaaatacaaaaatacaaaaattagctgggcatggtggtgcacacctgcaatcccagctacttgggaggctgaggcaggagaattgcttgaacccgggaggcgaaggttgcagtgagctgagattgtgccactgcactccagcctgggtgtcagagcgagactccatctcaaaaaaaaaaaaaaagaaaagaaaagaaagtgaggcagttaaaagtggagcttctttagtttacaggctgtatgtggaatcggtttatggcatctgcccagtacatgcctgatgggtgaatcaggcagtgattggtcatggggccaaatatcagagccaagagaagaaagcacaactcagtaataagtggacaagaaatgtgataaaagggtcagttgagacaaaaactcagtattaaagaccaaagctaaacagttattctcaattaggctttcctgaattttgagattaaagaagcaagaatagtttttgcaaaatatgaaagaatcctattgaataatattttgctatagtctaatcctaaaataggacatagaaacattttttttcttgagtgcctaccatatgttggtactgttctgagtgttttcatgcagatttccttcatctgtttttagataccatattgtgttcgtccattttgtgttgccataaaggaatacctgatgctgtgtaatttataaagaaaagaagtttatttggctcaagccttttcaggctatgcaatcatggtgccagcatctgctagtgagttctcaggaagccaacaatcatgggggaaggtaaaaggggagaaggcatgtcacatgatgaaagagggagaaagagagaggaggaggctccttttaacaaccagcttttatgtgaataatagagtgagaactcactcattaccatgggtagagcatcaaaccattcatgagggatccatacccatgacctaaacaccccaccaggccccacctccaacattgaggttcacatttcaacatgagatttggaggggacaaacatgcaaactatatatgaataataatttttaaaaaaagtgaaagaaaattgctcaaggcacaaaggacctgagtccagatttaagaacaatcttctttccttttatttatttcagcctgaaaactaaaaaaaaagtaagatttttttgcactttcctctaactttcaaagtttacacacccagcccctgtgaaattaaagaatgatccatcaaaatgtgatgacacttaagatgcattgactgtaattttcgccagtagtccaccactataactcccatttaaagaacatggtctcaggccttgtgtgcatgaagttcacatgggaaaaattttaaacacgtgttcctggtgagtttaataaccaacaattctggtttaatagatcagggatgggaccccatgtaagtggttaaataaattttttataacaaagaaaaaaaaagtagtgatttatgcatgtggtcacagatgaaattttgaaatttttctctgtgcttcatgtttattttacatgtgggtaatggaatatattatgaattgtttcaaggatttagatatcgtaggtctggttgcagttatcacaggtaatgttaatggaaatccagacaattagacgatgataaccacagctaagtctcaggaaaaacaggtcagattagacaaccactcactgcggggagcccagatatgcatctagtctgattacccactggggaagaaagagttaaagcagttagcttttcatccatttcttccctgaaaagtagactaatgatctagtcttactctttgtaaacataagttgataatttgacctcttggcaataagagaaatgatagttaattaaaggaaaatcattatctagaatgctaatggttgggtgtccctgttttagcattgtttatagaaaccaacaatctgtgggttttagagggctgactctccaaaaaatgtcatataagatctataactctctggctctataaaatggagatgcttcctattacaaatactcatcactctgtgaggtgacccacaaatctctgttagagacctcatttcagcctgggacagagagcctgtgtccaatgtgaggaaggaaagatttagagagccacatggaatgcccccagttttctaggctttgcttttgttcttgattgtctgggtccttgaaactattagtaaagcttgattctgggcaagatctctgattaatttgatttgatttgacaacccaatcatttatgttagatcaattagtcttcataatgttgtcagagatggtctcattggttaaaacattccaccacagtaccctgtaacacactgatttacccattaattaaatgatatcatggaagcatgaaaactcactacagttccaaactttcttggactagtcaaaggacatagttggtatgcttatacaagctaggtccttaagcacaattgttcattgtaagaaaagaaaccaaaattatagttttgatgttataatacagatttaaaacttaaatattttgaatattttacttctaacatatttacaatggtaaaaaaataatatttttcagttgtggttaatgttaggcctctgagtccaagcctgctcatatacttccagatggcctcaagcaatggaagaatcacaagtgaaaatggcgagttcctgcctcaacagatgacattacattgtgaaattccttctcctggctcagaggctccccaactgagcaccttgtgaccccccgcccctgcctgcaagagaacaaccccctttgactcgttttccactacctacccaaatcctataaaactgccccacccctaactccctttgctaactctcttttgggactcagtccacctgcacccaggtgattaaaaagctttattgctcacacaaagcctgattggtggtctcttcacagggatgctcatgacagttaatacaaaaatagatactccaaaaaaagtgttggaggaataaaattactttataattatccggcttgtcaatgttgtgcaaagctgcactccacatggtgggtactatatatatacagttttaattattttacatttagtacttgcttgaccttggacaactctcttaatctgtttgagtcagttttttgatctgtaaaatgaaaaacatgaaggaccagaggaagtggaaaacaagaatgaaagagataaggaaagagaaagaggaagaatgaaggatgaagaagaggaggaggattaaataagggaaagaagaatgtatgtgacggcacttagaatagactctgacaccttataagtactatgtaaatgttaacaagtataatttttaattttaaaaaatttttagctacatactatttttagacaaaaatttaaaaatttttaggcatagttctacatatttatggagaacagtattctacatatgtatgtacatgtaagtatacatatataaatatatatatatatataaatcaatgtgttttatccctttttttttttttcagaaaacaagcatacaaatatctacatgcagtaccatgggtattctaaatttcatcctttaccgaattattggaaaagactgtatgtaacatttcttaataaatgtataaataattgtcttataaatgcctagattgttaaaatataggaagatagaagtttgctgacagtgttggaaaataattaaaagcaaaatatcctgctatctcagaaagtctctccataaatgaagcagagttttgctattgaataaacattaaagaaggtagtaatgcccatcacaggcagttcctaaagggagcacaaaatcagaaagaaatctgacccttttatatagctaggaagatacaatccaatacatatattttcacaggataaacaactagtactcaagtaagaggaggtaacagcaccatttgcaatatactgttgattctaaattcacctagtaatagaagtggctatctgtgttagttaattgcctttatccagaagaaaaatggaacttcttatatcttcttgacaagcaggtagttttacaactagaaatcaaacacctaaattaaagtctcactctcctgcctaggaggggagatagaggcactaatgtccttgacatttacatttcaaagagatggctcccaagcccctgaggaaaacatttctggttataaaactggagaggggcttatttagcgtttaaacaggtttacataccactcaactggacatggaaaggattacaattaccagtttcctaagggaaatgctctaagaaaagaggggaggtctctttctccttttcaccagggaaattttcaaaatttcttttcagattcttatttgcccttatggtagcataggcttctgacaaaaatgagattttattagagtttagaataaaacagatgttctacaaatgaggttgttgctggtttaatatttcctcacattcatttacttattcttcccagcttttgattccacaagggcttgttaataaatctccagggagctgtttgcctgtgtcaccaaaagtctatagaatattctgtgattaacaaaaacagacacacagaaatcttctgaatagaaattcagaatcctagcttgtcccttcttttaagatattttagatgttgctaagcatgaaggctatgggcttatcaccacttcatgttttgtttttgatatgaaataactctcttttacaaaattatacatttctaaaaaatgggtccaatggaagagattagattgatgtgacacaactggagtttttaaaaaatgagcagagagactgttccaatgtcaacattaacagtggtgtcctgatcatttcccctgttaatgttaaaatgaacattaatttcttccttctttatataccagcatttctatcatttgccagagaatagtaatcgctggcttcatagaaggctgtaggaagagtaagtgctctccacaagtccagtctggttgctctgagtattcacagacaaatgaagtccaactgcttattctcactgtgcaataacaagatgcagacaaactgggaaagaaaggagtttatgtctgcaatggttacagggagaaggttggagtaactcaccagaccaactaaaacttacaacttttttttttagcttatatatacaattcaggtttatgcctatgtgccggagtctttcttttctttcttttctttctctctttctccttccttccttccttcctctctttctttctctccctccctctctccctccctccttcgttccttccttccttcttcctttcttcctttctctctctctcactttctctctctttctttcctttttccttcctttcttcctttctttctttctttttctctctctctctccccctccctccctccatccctcccttccttccttccctctttcttcctttcttcctttctttctctctctcactttctctttctttctttttgtttgagacatagtttcactcttgtctcccaggttggagtgcaatggcttgattttagctcactgcaacctccacctcccgggttcaagtgattctcctgcctcagcctcccaggtaactgggattacaggtgtgtgccaccatgcctggctaatgattgtatttttagcagaaatgggctttcaccgtgttggccaggctggtctcgaactcctgacctcaggcaattcacccatatcggcctcccacagagtatttcttaatcaatctaatcttaactaaaggtctgcatgtaggaaggttttttagatttgttcttggactagattaaagaggttgagaaagtccaggtgtggttttaatgggtttgtttttgcattccagcccttgtactcaggcaccaatttctccagttctttaatatttatcttatacattcattattacagcaaagggtttacgcagacttacctgcttgtggagctctggcctgccacaagaggactgagcccagaaagagtacctctgccaaaggacagggcccctgaaggcctctcccaaaggtgatgcctcatatagatactgaagagtaatttgccaagtgggaaagcaggataaggcatttcagtcaaaccaaagttataaagacttgaaaaaagatatttatttggaaataagtatttgtgtgtatatttgtgtatgtgtgtatgtgtgtggtggtggtagtgattatttagtgtgttagaggagaagtgtcaagaaaatggctagaatgtgagtcaagagctatgtcctcctgaccttaagcaatagtatgctatgtaaggcattttgcatttcatcctgaagaaggttctgacagatttcagcagagatggaaaatcattagttgcattgttgtaataaaatcttctcttttaacagcttgagataggtagaggaggcagcaccaaagaagttgtgcaatacgaggccggcaggatggcagggcttgtgccaccagcagattcaatggagggaggaatttagaggagcttgtcaaagatgagaggttgaaggacatcacatttgagaattaggtcttatagttgtgaatttagccttaatcaagcaaatttgtagctgattgctgttaaaacttgcactactgaatgtaggattccttcggtgtttcttatctgttaaaaaacaacaacaacaaaaaaacaaacaaaaaaaaacagtgactattttatagccagccttctctcttgagaatgtgtgccaggagagtgaatgaggaacaggcagctgtcaggtggctgaagaggacccaggaggtcacctcaatgagtggctaatttggcactgaggctgatgggaaaggcacattgctgtagtcctttttgtgcctcttaattaaatgcattaaatttcaattttcttaaaatgcaggaattgaatagatgaccactaaagacgctttcagccgtcgtggtctaagactcttgattgacatcatctaatttggagctcatggcatagttttccatttttaaaccttctatttttgattttcatgagaaaacctttctatgtctggtcacatctactttatgtgagtgaattaactagagagaaatatattatagaatacctttcctccttttgttattagaataatctttttcatgtcaaaaaacagtgcagattgtctgtgaaatggaaatggtattctgaaacttgtgtagataattaaaaaaaaaaaaagaacatgatgtgattttgcctaactggtaaggtgccactttgcaaggcacaggatggcgtccacagtgaaagcttccaccttcctatgctctgcctcagatggtcccattggcgtgctccacttcagttttcaaagctaattagaatatattcacttttgtctgttatatattcagggagaaaccctatatctgtacaaatgaggtagccttatattgccagttgagtttactaaaggtctcagacagatgagggactgtcagagagatttccccaaggaaagtgcagagcagagatgggcgccctgtgcatgggcccctactctgtatgctggagggtatgctggagcctgcttaacagtccttcgataattataacagttatataaagatttattccaaggtttaggaaaatcagtctcataaaaatgaaataacttagcccacattatgaactggtaaaaactagtattttggggagccggaatgggaacacaagtttgattctcaagccattacctttcaatctcactctgattcaaaataaaacaatccatcacccctcctctggaagcaaccataggaggaaattcacccccgatatttcatgtggatccttttctattttccctaagtgtcggctggtctgagaaataaagggaaagagtacaaaagagagaaattttaaagctgggtgtctgggggagacatcacatgtcagcaggttccgtgatgctccccaagctgcaaaaccagcaagtttttattagtgattttcaaaaggggagggagtgtacaaataggatgtgggtcagagagatcacatgcttcacaaggtaataaaatatcacaaggcaaatggaggcagggcgagaccacaggaccacaggaccggggtgaaattaaaattgctaatgaagttttgggcacacattgtcattgataacatcttatcagaaaacagggtttgagagcagacaactggtctgaccaaaatttattagatgggaatttcctcatcctaataagcctgggagtgctactggagaccggggctcatttcatcccttatcttcaaccgtaaaagacagctgtccccaaagcggccatttcagaggcctccccttagggacgcattctctttctcagggatgttccttgctgagaaaaagaattcagcgatatttctcctacttgcttttgaaagaagagaaatatggttcttttctgcctggcccacaggcagccagacttttaggttttctcccttgttccctgaacattgctgttatcctgttcttaaggtgcccagatttgatattattcaaacacacatgctctacaaacaatttgtgcaatcatcacagtgtcccgaggtgacatacatcctcctcagcttacgaagatgatgggattaagagattaaagtaaagacaggcataggaaattacaagagtattgattggggaagtgataaatgcccatgaaatcttcacaatttatgttcagagattgcagtaaagacaggcgtaagaaattataaaagtattaatttggggaactaataaatgtccatgaaatcttcagaatttatgttcttctgccgtggcttcagccagtccctctgttcagggtccctgacttcccacaacaagcaacaccacaaaacaataaataactactccacccttgacccagagcaatgggagaaaggcctggccaggagaaactaactttgttaaaagtctaatactgtaggccctgccagcctcttgtatttattcatcagatttaattatcaaaagaatactcatgaaatagtaatatcatcactttatggatgaatagtaaatggtgaatcttacatcaaatatgagtatgctcaacttcaaagccacttctacacctggagttttggatatacagaactgttgtgacaaacaactgtatgagttgatattttctctgccttctaattgaggaaacaaaggtatggggagattacatgtgtcaaacacatttactaagttggaacatcccaagtggggatttgaacccaattctcccacttttctccagtgatctgtctctacctgatttctaaagtcaccaggaatgctgtcctctacacttttatgtaggattttgtttcagtccaaaatgcccttccctacatgctagcaaacttaatcttcaagatcttggatctttaattgaaaaacccaaaaatctttaggaacctgcagtacacctgggtgttgtgctacatgccaaagaaactccagagagaaattctgttgcctttgtaaaagttgtcaaaatcaaaatggagtcaatagtgtcagggcaaaaacaaacaaacaaacaaaccaaaacaataacaaaaaattcccaactttgacaaatagagttacagaaggccatagaataaaaagagggggaaccatgtgtgtatgcctactaacagaaactatcaaaaaaaaaaaaactgcaaaagccacaaccttgcacaaaagccatcactgctttacacaaaagttacttctgcaaggatatcttcccagcaactgcctgtccaatcttggactggcatcatctttgttattgaatgtcagattgttcttgcattgctataaagaaataactgagattgagtaatttataagaaaaaggggttgaattggcttatgattctgcaggctttacagaaagcattgtgctgatatctgctcagcttctggagaggccccaggaagcttacattcaagtcaaatgggaagcaaacatctcacatggcaagagcaggagtgagagagagagggaatggaaatgccgcactttcaaactctagatcttgtgaagacagcactaagggaataagtgttaaactatttgtggaaacccacctccatgagccaatcacctcccctcaggccccatctccaacattggggattacatttcaacatgaggtttggggtaacaaatatccaaaccctatcattctgccccttggaccccaaatctcatgttcttctcacattaaaaaatacactcatgcctttcaaatagttccccagtcttaatgcatttcagtattaactcaaagtccaaagtctaaagtcccatctggagctgagtttcttccacctatgagcctgtaaaactaaaacaaacgttttatttcaaagatacaatgcaaattcaagcattgggtaaatattctcattccaaaagggagaaatcggccaaaagaaagggcaatgaaccccatgcaagtctgaaagagtacaaagagaggaattttacagctaggcctccgggggtgacatgacatatcggtaggaccgtgttgcccacttgagtcttaaagccagcaagttttattagggatttcaaaaggggagggggtgcaaaaacagggagtatctcacaagattacatgcttcaaaggcaaaaaggagaaccacaatcacgtgcttctgaggaaacaggacaagggcaaaacagaactactgataagggtctatgttcagctgtgcacatattgtcttgataaacatcttaaacaacagaaaacagggttcaagagcagagaaccggtctgacttcaaatttaccagggtggagtctcccaatcctagtaagcatgagggtactgcaagagaccagggtgtatttcagtccttatctcaaccgcatgagacagacactcccagagtgatcatttatagacctcccgccaggaatgtattcctttcccagggtcttaattattaatattccttgcaaggaaaagaatttagtgatatcttccctacttgcacgtccatttataggctctctgcaagtagaaaaatatggctctattctgcctgaccctgcaggcagtcagacctcatggttgtcttcccttgttccctgagaattgctgttactctgttctttttcagggtgcactgatttcatattgttcaaacacacatgttttacaatcaatttgtgcagttaacacaatagtggtcctgaggtgatgtacattctcagcttacgaagataacaggattaagagattaaagacaggcataagaaattataaaagtattaattttgggaactgataaatgtccatattaaaatgaaatcttcacaatttatgttcagagattgaagtaaagacaggcataagaaatcataaaagtattatttgggaactgatatatgtccatattaagatgaaatcttcacaatttatgttcttctgccgcgactcaagccggtccctccatctggggtccctgacttcctgcaacagcctccaatttcatatttccccttggcactgttctagtagaggttctatgtgagggtgccacccctgtggcaagcttctgcctgggaacccaggatttctgatacatcctgtgaaatctaggtagacactcccaagcctccttcagtcttgcactctgcatgcctaccaggcttaacaccacatagaagacagcaaagcttatggttgtgccctttggagttgtgtcccacgctgtatatgaggcccttccagacttagctggagccagagcagccaggatgtgaggagcagttacctgtggtggaacagggcagtggtacctcaggcctggccctcaaaaccattcagtcctcctaggcctctgggtatgtaatgggaggggcttcttagaagatctctgaaatgccttctaggccttttctccattgccttggaaatttgcacttggctcatttttcattttgtgactatctctagcaagtggttgctccacagctttcttggattcttactctgataaagcgttttctttgccacatggctaggttgcagattttctaaacttttatgatctgcttcctctgtaaatataactttcaactttaagtcatttgtttgctcccccatctgatctaggctgttagaaatagccacattacatctttatcacctgctgcttagaaacttctccgaccagataccctaggacatcacttttaagttcaaatctctgcagatttctagggcataaaaacaatgcagtcaagctctttgctaaggcattacgaggatgacctttgctccaattcccaatacgttcctcatttccatttgagacctcatcagcctggacttcaacgttcatattgctatcagcattttgttcacaaccacttagtggtctctaagaagttccaaacattccctcatattcctgtcttcttctgtgccctccaatcttttccaaactctggccattatccagtttcaaagctgcatccacaccatcaggtacctttatagcaatgccccacacttccgtaacaattttctatgttaggctgatctggaagtgctataaaaaatctgacactgaataatttataaagaataaaggttcaattggcttatggttctgcaggcttcacagaatacatggtgcccgtggcatctgctcaacttctggggaagcctcagaaagcttacagtcatggtggaaggcaaaggggaagtcaactcacattgagagggcaggagcaaaggagagatgaaaagtgccacatactttgaaacaacaaggtcttgccaggataggaccaatgggacggtattaagtcattcatgagaaattcatattcatgatccaatcacctcccaccaggccccacctctaatattggagattacattttaacatgaggtttggaagggaaatatccaagctttatcatttatctttgtagccaagggtatttgttgtaaacaattttgtaattctcagtttattctttataagcctgtgtcttcctttaccccacagaatatgcacatatttttattatggcatgtgtattcccattgtattgctttattcacaaataaccttttattctagagcctctctttatgttattaatattgacatcttgatcagtctaatagagaattacctcggatcatggtcaaatcttacacctcttcagaagcccttttatgtttctccagaaaaagtaacgtctgcctttttttcaccttcccagctgttttcctgtgtctctgttttgacgtttatcaaagctgtccttttattctacctatatataaggctgtgatatctgcaaaaatttgaatcctgaggggcaaaaaaatgctatttttggcatctgtccccttcagtcttttgtatgggaatcaataaatatttgtgcaatttggaaagtggggtaaaaattcccatggctgggtgcggtggctcacacctgtaatcccagcactttgggaggctgatgtgggcagatcacaaggtcaggaatttgagatcagcctggccaacatggcaaaatcccgtctttactaaaaatacaaaaattagccaggcatggtggctggtgcctgtaatgccagctactcaggaggctcaggcaggagaaatgcttgaacccaggaggtggactttgcagtgagccaagattgtgcctttgcactccagcctgggcaacaagagcaactccatctcaaaaaataaataaaaaaataaaattaaaaaaaaatatatcccttgatacagagtggaaagaagaaaaagaaaatcaaaggctcattaaccagaaagaataatccatggttaattgctcagtatggtataatgattctccaatggcagatggtatttgggtagtatgtgttaaacttttggcccagtaattttttctctgttcttctctttcatcacctttcagaagtttcataaaaacagcttggaagttcagatgctttctgggctgtcatgctttcactatgacaattactctgctaatcaccaacaccttgcagattaatggagattagcagtgggcctgaggagtgagaaggcacactgactccgaggcagcatttgcaaaaaccctcaaaggattccaggtgaacaggctagtagataagaactaaacaaaatattttgaattatttctcaggaggatctgtagaagccactgcactctatgaatcaatggaggggtatgaagattgaccctgtagttcttcaagtagtgtctcaaaagagaaaacatgggacatactttcaccagaaattagaaaaatgagatgagaagaaaatattccaagtctcagttagtttgggattctcaggattaaataaagtaattgggattttgttacctgggaatttttcagagccctcaataagccaggaagcatggtgagttttaagtataaaatcaggtacttagaattaccctgccttatttgaccacatactcatcttcttttcatagcatagaggttctgcagaggactgtgggaaattctgacttaaatgcggaattataaacagaaggtaaattgtccttctttgagaatccattagtacccactaatgagtgttacatgctttcatatacatttttcattgaatctaccaaactcatcgatatagaaaacactattttctttccacagatgtggaatcaaaagttcaaagagcttaagtggcatactgaagctcagcagagttatgatttaaatcaaagtctggctgattatatccctaaattgacagtgatggcacatctccttgacaagaagaaggaggtctccaatgagcttgaaggcaacagaggatctccaccatgattagattccattgactgggtgacaggtatacaaaatagttttagcagttactgtagtcatattaaaatggaatataagattaagttgaagatggggcaaggaatcttggaaattgaaatactattctagatagctttgcctcttttttagttgcctgcaggaaatatttgccctggagacaatggaaagctttagatacttggttagaatcaagaaggggaaaagaaaaagacaaaacaaaaaacaaaaaaacagaaaccacttctcattgacgcccaaattaaagcaggtaaatttttccacccaaaactctctaaggtaaaacaccagtttctttatctagtttatcttgttggactgtggaagaggaagggtccttctgattccctctctccaccgccactctcagagcactgaaagtgcagcatccataggctggcatttcatggcagatctgagccagtgtaaacaccggcccctaagaccccagctcattaaaattttcctgttctttgctgcatggaaaatcctcacttctttaggatgcagttaaggtgaacaggggagaggcatttctgtaaatacaaagtttccaggaaaaagtgtcaggtgacctgtaaaggattgcaagcacttagtcttaaaaactgcaatgtctagaatatggaagagtggtgtggtttttgttaagatggaatactgatatttcactttatctttcctactgattgcaactaagagtcctgaatggaaatcattaaaaaaaacctctcagggtggtccattttgtgtgtgtgtgtgtgcatgtattgctgtatgtgtgtgcatattgctgtgtgagatttttcctcatatatatcttgaattagactgaagaaagcctgaatccctgaactgtgcaacaggcagaacaggaaaagtctgagagaaacccactattatcagttcaaggactggcttccctagagaatggagttagagagaggaatacttcctcttcttgtttgtttctgtgtgtgttattttaatgttttcccagctcagcccctaggtaagtctcagttccaaaagtacccttcagcggaggcagtggcagcagccactgctcagacacttaaaactccgagagaaaaagccaattccctgacaacagtaacaggagcaagcttcccctgtaatgggaacagtgttggggaggaatctctgccacacgctacttctctctttcttcctgctgctttgccccagaggtagatccagtttaaaagtatgtaacagcacaagagtacagtagcagatacatatatattgtttggaaataataaaaattaactagaaatcaataacagaaaaatgactaggaaatcttctaagtatttgggaattacacagcaaatgtccatagttttctacccggaatactagagaaaaagctcctgtgtactggagagtgaaagaaatcacaaggactggggatctcaagagaggggtcctacaaagctgtgtctgaagtcctgggcccagcctagagctacagatgcgtaggattgattggaaacggcacaccaaagtgactgagaaagaagccatgatgtagaccaacaacgaggaagcagactgcgctccccaaaggagcacagatagagccaatttggatatccctgcaaaggctttaaggctgaactgacatcgggactatagaaagtgagtcagactggcatcttgatcctaactagggtcaatggtagattaagaaaagcaaaaggatgggaagaaaatctaccatgcaaacactaatgaaaagaaggttgtattggtatggtaatatcagacaaggtagacttcagaacaggaaaaataatcagagataaagagggacattaaacattacaaaagcgacaattcaccaggaagctataatacacctacatgagtatgtgcttcataacagagctttaacatctgtgaagtaaaaactgtcaaaataggaaggagaaataaacaatatcccatttaatgataaaataaacagaaagaaaatcagcaagggcagagaaaacgttaaacaacttcaactaaaagactgagttgatcaatgggaacacaccacacagctacagcaggatgcacatacttttccagttctcattaaacatgtatctagttagacatatcctggatcataaaagaaaccttcacagattcaaaataatacaagcctgggcaacatggtgaaatcccatctctacaaaaaatacaaaaaattagccagctgtggtggtgtgcatctgtagtcccagctactcaggaggctgaggtgagagaattgattgagcccagaggtcaaggcttcagtgagctatgattgtaccactgaccactgcagcactccagcctgggtgacagagcaagaccctgtctcaaaaaaaaaaaaaaaaagaataaaataatagaaattttagtatacgtatattccttgaaaataatgaaaattaactgagaatcaataacaaagagaactagaaaatctatcaatgatttggaagttaaacaacaaactttcaaatagtccaaattatccatagtaattcaaccaagaaatctcaaaggaaagtataaaatattttggagtgatttaaagtgaaaataaaatgaaatgttgggggaatgagctaaagcaaagcttagctctatctccatatggaggacccatatggaggatttgtagagtgtttctgtgttaacaccctcccttatgcactaattctgtgaaagtaagaggatatgtttttattgcctgaatattcaaaaaaataaagaggtctaaagattttgaaatatattaaaattggatatgttgagaaaaactaaatccagcaataaacaattgatatatgtaagacagaggcagcaggaaaaagtgaagtagactggagcttta

SEQ ID NO: 621 - DNA, 1027645 bp, Homo sapiens
ccagcaaacattctgaatgccaaaactaagcatattgacttccagaataacatgacttctatactctattactggagtttacaaaactaaaaccaaatgagggtatagatgtacctcagaacccggaaaaggaaacatccatgaggaaggattctgttcagttcgctgtgtaaattatctgaaagtgctggcctgactggaaccttaaagatcacctagatctgcggttttcaaactctgctccaagcataagagagggtggaagtaggacaatgggaaaagggaggttaaatgggcagggctctagacagttttatttggcctttacaggatgatttcgttgaaaaaacgagtgttgcttctaataaaaaatattgactagtcattatctagttaaataatctcactttccagatgaagaatggcacccaaagagcgactttgaaagttgacacagtaagttagtggcattgctgtgactaaaattcaggttccttacaaagaaaaagtatgtggctaaaagacttgctttctagcttttgcttgtttttccaactttgttccaagtcatgtgctaggttctagggcaacaaaaataaggttagcatctaatgtgaaaatcagatgagcaaatcaataattacaatacattattgtaaggacttcttggacttaagcacagggtgctaccagaatgccgaagaggagcatgtaaatctgacagcagggaagagggtaggtgatagcagaatagaatcttgaagaatatttagatgtctgacacaaaaagagtagagtgtttcctttctctcacagagaatactatgtgcaaaggcactgaggtgagagaaaaaattatgttccagaagtggaaacagcatggtgtactagcaggaaaataaactatgtgggagggagcagcacagcagtgagagaggagaggtaaacagaggccaggtcacagaggccttggatctctcagcccaaagaagatgaggaaggagccacagtcaccaccactgtgccatttaggccctctgggcagactggatcagtcagatcaatcatctgattggatcatttgcctcctaagaaatacaccctattggatctgattggatcatttacctcctaagaaatacaccctatttccaagccactgtctgcctaactatatgcaacacttcctctgctcttaaagggcatttctaccgctgacccttatgataactggttggtaaactgaggaataagaattaagagatgtgtaaatcaggtatttgtttctattgacttttcctctgcccaatttataaaaatatttcaacaaagagagaaatagtcaaggcattgtcttggagatggtttacatcagctgagcatggtttcagatctttagccagataagcaatgaaggaaatattctgaatcagagctctgattttacgttgttcttgaagtgcaaaaacaaaataaaacaaaataggtggtgaggataatggtattaatataaagaattagaaacatgagtgtgttaccacaaaaagtataccacagcagtgatattattgcttccaatggaaaaacatgtacctgcatatctacactcacacacaatgtggtgccaaaggcaattcatgagaattaaaaagttttatttctcttttatttctgccttgccataattctggaattcaatagatttccagagatgtgtactttgagttagacatacctgggttcgaattttagctttgcttctttttaacaatgtgttcagatacaggttatgtaaccctgtgaacatcagtgttcacatctatgtaatgaaaatgatagttaatcatttcttttgtgagaagtaaattaaattcaattcagttaatttagaatatacactagtcttattttgacttttatttgaatctaagctacatatcagaaggtgtggggttaacatttggctgtgtttcctctgagactagtaactgaaagctgatcaaaaccaatctctccacatcagctcttgaactgggacctcagcccctctctgtggtgattgcggcactgattaaacctggcagatcagaggaagtagaggaagaaatactacatgaatcagtatcatacaggttaggcactgtacagtcaacccttgaacaatgtgggagttaggaggcatacataagttttgactgtaccaagacttaacaactaatagcctactgttgaccagaagcctcatcaataacacagttgacacatattttgtgtgttacatgtattatatactgaattcttagaataaagtaagccagagaaaagaaaatgttatttaaaaaatcataaggaagagaaaatatatttataatgcattaagtagatgttggtcatcaaaggtcttcatactcattgtcttcacattaagtaggctgagaaagaggagaaagaggagcgactagtcttgctgcattagaggtggtggaggtggaagaatatttgtgtgtaactgaacctgcacagttcagacctgtgttgttcaaagatcaactgcaatttaaggaagaactccaggacttgggttagcaccagaggcaagcgttggatatattactgaatatgaatcatctgccttaaaaaaatagactaattagttgttcactgccgtataaaccttaggtaattataggacccagagttctgagaaattaaaataaacatcattttaaaacggagaaaagtaatgagagctatttgtagggctcctgaagtgcttttcggcagagcggtctagcaggactgtcaagatcatatctcgaatcttgttaatgtgaacatttatcatttaaatctcgtcactacattagctaattgaaaccatttaagccaagcaacaggacaatttaggctagaaatagggcttaagatttctctactcagtgaaaatcaaaataactcagcccattccttgctcccttaagatcacagaatctgtgttggaagggatcttagggtatcagctagctcaatctcccacccatacagggagccccactataatatctctgtttgtgctttcccagaattttctcaagtacttttgcagatacaagactcactaattcataaaaaaaagtttttgtcagctctaattgttagaaaaatttttccgtatttataggaaatagctttctttttcacttgcagtcacttgttttagtatggacgccggaacacaaaacacttgccttctactcaagcacctttctgttgtctgaggacatctctcatgccttccttggatatcctgttttttaaattcagtatctgtttcctttaatgtactccatgagatataagtcacaaactaccctcctggttgtcctcagctcaatgtaattcagttggtcggtgtttttcttaaaaattatcctgcataacggaacaaatttttgatatataaagtcacctttttttgtctttaagttttttgttctgtttagtttggtttgtctttagttcttatattgacctttggagtatctaaatttgtgggtagataaaaacctaactcttggataggtgagcaattatgtaacacatcacagataaaggcccttctaaaaccaatatagaagtcttccagattaacaaactagtaactagaaaacagacaaacaaagaaaccccaaattcaatgtcagaagaaattagaatagtgtagtataacttatttttgagtcttgaaccagctttgaatccctgcaacatgccctacttggtcacggtatatagtttttaaaaatatagatagctgatttctattttatgggtaaagatttttgtgtctatgttcatgtggaatatcattctgtagtttcctttatcgtattgcctttgttttgtcttggtatcgggaaaatagtagctgcataaaatgagtttgagagtgtccccgcttgtttaattttatgaaagaaagagattgtgtagaattgaactctttaaaagtttgacaggattttctagtaaaaccatgtaagcctgaggatttttggagtgggtagagggattttttaaattatgcatacaattttcttaatagtgaaatggctattccaattacctagcttatgtaaggtagtttgtaatagtttgtgacttttgagaaactggtttatttcatttaggttgtcacatttacctataaattgttcacagtgtttccttattatccttttgatatgctcagagtctgtagtgataacccctgtttcattcctgatgttagtaatttgcatcctctatcttttttgtcagtcttgctagaggcttgtctgttttattgatattttcaatgtaccggctttttcttttattgattttctgtttcaatttcattgatttctgctcttacctttattattccctttcttcttgctttgggttaattttgttctttttataggttctcagtctgaaatcatagaattttgatttttttgtcttttctaacataaaacattttcttctcaattgctttaatcgtgtcacacaagttttcaaatgttgtgtttttattttcattcagctcaatgtatttttaaatttcttttgagacatcccttttaacctttggattatttagaaatgtattgtttaagtgtgaggtgtttggagattttctgttatctatctgttgctgttttccaacttgattccactgtggtttaagaacaaactctgcatcatttcaattctgttaaatttccctaggtttattttagggcccaggatatggtctgtttttttatatattctatgggcacttaaaaaaaagtgtattctgctattgttaggtagaatgtttcgtaaatgtttacagattcacttggttgatgatgccaagttctatattttttctctttttctgtctagttccagcaattgctgagagaggggcgaagtctccaactgtaattgcggatttgtctgtttctcctttcagttttatcagtttcgcttcacatattttacagctctattgcttgtgcattggtgcatacaaatttaagattaccatgccttcttggtggattgaccctttctatcattatgtaatgccctactttgtctctactaattttctttgcttctgaaggctgctttatttgacattaacatagccattcctattttattttgattaatgtttggatgaatatattttttcatgcaaagctactttagttaattttgaagtgaatttctgcagacatatataattggtttatttttttgttattttattttatttatttactttttctcaacttttaggttcagggtacatgtgcaggtttgttacatggataaattgtgtgttgctgaggttttgtgtatgaataatcccatcacccgggtagtgagcattgtacgtgataggtagttttcaaccctcaccctcctcacagtctccctgctctagtagtcctcagtgctcagtgtctattgttcccatctttatgtccatgtgcatgcaatgtttagctcccacttatgaagtgagaacatgtggtatttgtatttggttttctgttcctgcattaattcacttaggataatggcctccagctgcatccatgtggctgcaaacaacatgattttgttcttttttaatgactgcatagtattacatggtatatatgtacaacattttatttatccagtccactgttgatgggcatctagattgagttaatgtcttcgctattgtgaatagtgctgcaatgaacatcacagtgcattcacaatgccaatttttgtcttttaattagtgtgtgtagacagttcacgcttaatttaattattgatataatcaggcttaggtctgccattttattttattttatttttctgttggttctctttctcttatttgttttgttttgtgcttttctttttcctgacttcctacaggttatttaaactttttttataattctatttttctaaattttgataggggttttgagtgtatccttctgtataggttcttaaagtacggctatcgacattacattgtatcatatacatacataatacatcactgtttactgttttttacatttcatcagttcaagaaaagtgtaaaaatccttacctccctttacatctctaccattcccaagttataattacttgaaattcttctcctacatacatttagaaacacattaatgttatcatttttgcttccaatgtcaaatatagtttagaaaactcaacaggagaaataaaacatatcgtatttaccaatatttttactctttctgttgttctttctttcttcttgattttctaatatttattattttatcattttctttctgtttaagaaacttctctagccatttttaaagttaggtctgatggaaacaaattctcttagttttccttaatctgcagatacattgacttcttctttcttgagggatatctttgctgggtacagaattgtgagtttgccgttcttttcattcagcacttgaaaaatgctgtgccacttctatctggcatccatgatttctgatgacaaatccattttcattcaagtcgtttttacaaacatatttctttctcattgctttccagattttttctttcttttcagttcttagaagtttgagcacaaagtgtcctgctatatctttctttgtttctttttttcttttcctgtttactcaactcttgattatgtaggttgaggtcttttgtcaaatttaggaacatttatgttattacttcttcaaatattttttcagcttggccttatttttttgtgactctggatgacacaaccattagatttttgttgttattgttagagttacaccagtttcccaggatgtggctttgtttttctgttaagatagagtaattcacactttctgtctttaaattcactgattctttcctctgtcctcttgattcttcttttgagtttatccattgagcttttacatttcagatactgtgtttttcagttctaaaatttccatttggttattatttacatcacctattttcttgttgacacattttacctttaaaatttttttcaaacatgctcttacatgctcatttaagcatttttattatgactgctttaaatctttgttagataattctaacttatctgtccctcaattttgacacttattatctttttccagtcaagttgacatttttctttattttggtttgatgagtgatttttgcatgaaacctggacatttttgatattatactatggaattctggatcttatttaaaagttctattttatctgacttcttctgacactgctctgtcaggggcaaaaatgatgctacttcaccactgccagatggaggagaaatatgagttccccactcagccttcattaacaccaaggtggggttagtgggtatgggtgggaattttggctccccgctaagacttcactgattccatgatgcatatgagggagagaagtgtcatattacttcccatgtggtcaccattaacactgagtgtgtgtgtgtgtgtgcgtgtctatgtgtggttgtgtttgttacctctgagaggtgataaaaatcctgactttccactagtcattctctgatacaccccagtatgtatgaggaggggtgccttgttactgacaagtagagtttaagtccaggccttccagattatatccactaaaactgcaggatggggagagcccttttctgcccagcatgatgaaagtatcaactccctactcagacttctctgacaccaacccagtggtgggattggggcctctctttatatcctgttaagaatgaaaatctaggttccctacttggcctttgtttgtgtgagtagaagtggtcacacggttttctccagtgtttgagtaagtagtgcaattattgtctaagaggtttttatctcactgtgcggccccttttctagaccctatctatagaaagaaagcttttgatgaagatatattttttttgtctgcatccattggcatttgtagctttctagcttcttcagtttccagtctggaatatatgatgccaaaaaaaaactcaaggaactcaccattgtccaattccttggatcctgaggtccctagccagtctgtcttcttcttttcagctttcagttttcttatgtttgcttcatagattatgtcctgggatttagttgtacttcatctaattttattttatttttcccctctattcacatggaattcaacacaaaatataaaaaaatatatctaacataatgtaagcatgtatatagaaaaccctcaataatctgcaaaaagttactagaactaataaatgaatttagtatggttataagatataaggtcaatatacacaattaattatatttatatatcctggcaacaaacaattacaaaataagaattttaaattcagtttacaagtggcatagaaaaatattaagtacttggaaataagcttcacaaaatatgctttatactatataagacatgcacactgaagctataaaacataaattagagaaaataaaaaaagaactaaataatacacagatatattccatattcctagattgaacaaaattaatgttattaagatctcaactctcatcaatttattacttagctacaattcaatattaatcaaaccccagactgtttttggtagaaattgacaaaataatttcaaaatatatttggaaatgtctacaatccagaatagccataaccatttttgaagagtggttgcaagaattacactacgtaatttcaagacttactaccagaaagctacaataatcaagacagtatagtattggcaaataaatatatatgtgaatcaatggaatagaaaatagagtccagaaacagacttatacaaacacacaaacatacacacacacacacatacatatatgaccaactgactttaataaagacatatgtgatcatttggtttttaaagcaattcaatagggaaatgacagtaatttcaacaaacagtgctgaaacaactagatatccatatggaaaaataatgtgccatgatatttacctcatactgtatttataaattaactcaaaatgaatcatagacctaaatgttaaagtgataaacttctaaatgaagacatttataaaatctttgtgaccttgggttaggcaaaattccgaaaagtacaatttatactctcttgagtacaagatgggaaggggtattacacttgtgtgtgtctgacagctatcactaattgtaggctgaaccaattcaaattggaatctttgattaataaactgaccaatcaattacctggggtacttaaaataagtatcatcattttggtgaaggcttaggtttaatttaaggacttatcatcagtgaaaccaaggaaataaaaatataatttaactattaactccaagaaaaagttttgatttgtgcaacacagaaaaagtaattttaattttatacatggttcagatatgaacaataattgtatggccatgtaaaattggctatttacttaaaactgttcagaactatgcatcataggagaatgcaaatagaataaatgtaggataggtgggacaggttgtaaaagagctaaaatgttatcttcagtagtaaagtcaaaaaataatgtctaaagtgaagaaaaagatagaaaagcaatataagcatgttattagaagtaagaagctgaatataaaatagagaataaaactgcaaaataaattaaaatttaggtgaggagttaatctggggaataaattgagggtaacagtagcctgagagtggtattgaagaccaaagggacatgaagcatgagcttctgctttaaaatattcgttcaaaatatttacttttagatgcaataaataggtcttctttgataaaaatgaacatcgcatttagaaaaatggaaagggaatatggtagagacggaggaaggaagatagaaaagagacagagcactacagtaagttgcgttattgtacagataatgactgtaaccttgcaggataaatgaactaaaactagctaaatgttatgcaaatgaatatttattacttgagatgaaaattgaaccgacagcctcttaaacttgtaaaataatctcaaatgatttaggcaaaaatgaagatgcttgttacctgatttcatatgtcactattgataatcgagattagaacataagatgcacagacagaaaggaattgtcatggctaagacttacttggcacttactatatgccatgcaattgttctaaatatgtatttttaagagctaaatcatgactcaattttatgatagtaactattattatcaccattttacaggtgaggaaagttgttcaaagtcacaactattaagagacagagttaggattcaatgccaggcagtctgatattccatgaagatcaaatgcaacaaagccatatttctgatgttgcttattattttgcctaatacattgtaatataggtgattatataaattgatgaatgaaataataaaagtaaacttttgattatatattcaagtttacatattcgagtaaattaaaagatattttggttgatggagggtagggaatattattattgggaaaatcagaggtaatttttatccagctatgctatattttatgtcatgtctgttaatttaggaaacttttcctggccaacagcacaagttacacattttacattatatgctttcatagcattccatatttttcctttacaacaacttgctataattcaaatttaaaattacatcataaatgtctgtataatttcttaaataataggtttcacactgatgggtgccttatcttttttcactgatatgctccctggtatccatcacagtgatgtcacatgacatatactaaatatttgctaaataaatgaatgaaaaaatacccattacatgaatgcaatgacatattcatcaattctctatgagatttaaattattttccttttttctttttgctattataaacacaatacctaaaggaatagccttatacatatattttttacatttatctgatttttttccttatatggatatctaaatgtgaaattcatgggtaaaattatgtgcactttaccagactgccctttatattttctataaattcatgcttcctttcatggtatatgcattggttaaggcaatgtaaggtgcttaaactgataagcccaaatcttagtggcctaagaaaaaagaaatttatttcttaatcatataaacttcatttggtggtgaattgcatagtgggacccatgcagtcagtgagagacccaagtggatagagcctggcaacttccatatatggcatcaaagtctccccgaatttctaaatccagccaacagggaaggaaaaagcggatagtatatgtacgtgtacaatatggtctggctgtgtccccacccaaatctcatattgaattatagttcccataatccccacatgtcatgggagggacccagtgggaggtaatttaatcatgggggtggttactttcatgctgttctcatgatagtgagttatcacaggatctgatggttttatgaggggctttttcccctttagctcagcacttctccttactgccacatgtaaagaaggacgtgtttgcttccctttccatcatgattgtaagtttcctgaggcttccccagccatgctgaactgtgagtcaattaaacctctttcctttataaattacccagtcgggtatgtctttattagcagcatgaaaatggactaatacaatgtgggagggatggagtgggtggagggcaggggatgttatatatcacttccgccacgtgtcattattcaaaacatctatgtgcaaatagagaaacatggccctgctgttgacttagaagaaaaggatcatctgcagtaaaaagctagctgctatctaccagcgtataaagagcctattctgtaccttgccaaaacagaattcaatcacgccttataacctttgccaatctgagagggtaaaagattacctgtcttacttcaatttacagttttaaaaatctctagtaagattaaacatctatctatctatctatctatctatctatctatctatctatcatctatctatgttctttttatatcatatttagtaattacctgctaatgtctttttaccacatttttattaggcagcctttattcttaacctcttaacatgtgccttatgcatagttttggattgaaatttaaattagtctgattccaaagcccgtttcttttagtgccattataactcaatagaaatggaatacttatctccaaggcctatatccttgagtattgttggctgaaagcataaattctagaaacaatataaaattgtagatcttgaaaaaaattgggtgatccatacatttagctgcaaaccaaagacttcagagtgccaagagtcaaggcaaaataactcatattaatcaatgagttcaaagagaaattaaaattaagtaagaaaatgagtggagagttcaaagccagggatggtaatggcagaggaatgagtttgaaggagaaatgagctgggtcctgaactataataacaagtggggctgacttggctttttgtgtttttattggcagtatgagatttaatttataaatttgattatgtacatattttcaaattatgtattatataaaataatagtatgatttacatatatggctttttccatgcttacattttgtgaaacaattttattagaactctttacatgcatatttgacctaaatgtctttataattacaagagccactttttctcttttcctaatttttctttaaataattaatactccaacaccccccctcccagcagcatttttatgtcagttctggtttagaagttttgcatactatttctacaattttagtggttccctctatacaggtatatttaaaattctaaagctaatctgtccttcccttctctatgtatcagttaagtttatgcttgggtgcatatgagagaaaacccaaactagcagcagtttaaacacaagggtttatatctctgcccgttttcacacaactataaagaaatacctgagactagggaatttataaaggatagaggtttaattgactcacagttccacatagctcagggaggcctcaggaaacttacaatcatgacagaaggtgaagggggagcaaggaccttctcacaggagagagaagagtgagagcgaagggaagagccccttataaaaccatcagatcttctgggaactcactcaccaacataagaacagcatgggcggaaccgcccccatgatccagtcaccttccaccaggtctctccctagacacatgagggttatggggattacaattcaagttgagatttgggtgaggatacaaagcctaaccatatcaatctgtctcatgaaataattttggaagtggtccttatagagctgatgtggaagattcatggttactgagtacccagactatttttttttattctgtcccgtcttcctagggtataatttccacctttaagatcagtttatcacccaatgtggctgctgggactcgagctattataccaacattctatgaataaggaggaggaggtgaaggcaaaaaagtgattttccatacaactgaatcatatccccttaagaaacctttatgaatatttcacacaaaatattcatttctcattgacaaggtattaatttataagttcacccagccgtaagaggccagtaggaaatatgaaactttggtcatgttgccaatctcaacatattttatttaactaataaaaatggaaaaatggtttttgtacattgattttgtatcctgagactttgctgaagttgcttatcaacttaaggagattttgggctgagacaatggggttttctagatatacaatcatgtcgtctgcaaacagggacaatttgacttcctcttttcctaattgaataccctttatttccttctcttgcctaattgccctggccagaacttccaacactatgttgaataggagtggtgagagacggcatccctgtcttgtgccagttttcaaagggaatgcttccagctttttcccattcagtatgatattggctgtggctttgtcatagatagctcttattattttgaaatacgtcccatcaatacctaatttattgagagtttttagcatgaagcattgttgaattttgtcaaaggctttttctgcatctattgagataatcatgtggtttttgtctttggctctgtttatatgctggattacatttattgatttgcatatattgaaccagccttgcatcccagggatgaagcccacttgatcatgatggataagctttttgatgtgctgctggattcggtttgccagtattttattgaggatttttgcatcaatgttcatcaaggatataggtctaaaattctcttttttggttgtgtctctgcccggctttggtatcagaatgatgctggcctcataaaatgagttagggaggattccttctttttctattgattggaatagtttcagaaggaatggtaccagttcctccttgtacctctggtagaattcagctgtgaatccatctggtcctggactctttttcgttggtaaactattgattattgccacaatttcagatcctgttattggtctattcagagattcaacttcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaggaacattccatgctcatgggtaggaagaatcaatatcatgaaaatggccatactgcccaaggtaatttatagatgtaatgccatccccattaagctaccaatgactttcttcacagaattggaaaaaactactttaaacttcatatggaaccaaaaaagagcccgcatcgccaagtcaatcataagccaaaagaacaaagctggaggcatcatgctacctgacttcaaactatactacaaggctacagtaaccaaaacagcatggtactggtaccaaaacagagatatagatcaatggaacagaacagagctctcagaaataacaccgcatatctacaactatctgatctttgacaaacctgagaaaaacaagcaatggggaaaggattccctatttaataaatgttggtgggaaaactggctagccatatgtagaaagctgaaactggatcccttccttacatcttatacaaaaatcaattcaagatggattaaagacttaaacgttagacctaaaaccataaaaaccctagaagaaaacctaggcattaccattcaggacataggcatgggcaaggacttcacacctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaggtgggtgaaggacatgaacagacacttctcaaaagaagacatttatgtagccaaaaaacacatgaaaaaatgctcaccatcactggccatcagagaaatgcaaatcaaaaccacaatgagataccatctcacaccagttagaatggcaatcattgaaaagtcaggaaacaacagttgttggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccctggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgaaatcacatggacacaggaaggggaatatcacactctggcgactgtgatggggtcgggggaggggggagggatagcattgggagatacacctaatgctagatgacgagttagtgggtgcagcgcaccagcatggctcacgtatacatatgtaactaacctgcacaatgtgcacatgtaccctaaaacttaaaatataatttaaaaaataataataaataaataaataaataaataaatggaaaaatggatatgaagtaagcaactaggagtctttgtagctatatcttcccaaataagacaaggaacttaaggtcatcttctatttaaattcttctcttctgtttcatgtattatgacttgtattttatttatttatttatttattgagacagagtttcactctttttgtctaggctatagtgcagtggtgtgatcttggctcactgtaacgtccagttcctgggttcaagcgattctcctgcctcaccctcctgagtagctgggactacaggaacccgccaccatgcccagatattttttgtattttttggtagacacaggttttcaccatgcttgccaggatggtcttgaactcctgacctcaggtgacccgcccacctcggcctcccaaagtgctgggattacaggtgtgagccactgcgcccggccgcattttacttttttctagtcttttcccattctctttattctccttttctggaattcttaattaactcatttatgttgcagcttccttttcttccctccatgtttcttaatatgtccttcgtattttgtgtattttcttctatttctgatactttctcagatctattttcagatttactaattcaactgtctatagttcaattaatttttaattttaattattttaatttttatttctagaattttaattttgcttttctaacctacttgtgcttttgtttcattgacttattcttgtctgtaggacttgcctcattcttttttcggaaaacatttttaattgtccaatagttttaagcttatggaaaaattgtaaagatagtacaaagaggtcctctatatccctaagccagtttcctctattgatcacatctttccttcttaatatatttgaacataattgaaatatttactttgaggcccctttctatgtattttattatttccagatacctgggttaaagttctttccacatattcgatttgctaattctcatttatggcagtatgtttcctcatattctttaccatttttataaaccataaactatttttcactgataattttcttgatcagttttcacaaatgtgcttcgggttatggaaatataattatggatggatttttacttgattctacctggtataatggattttctaggctttatatgtttcttcagtgatttctcagatgggattttatctagtatgaatagtataaattcggacttttcatccatacactgcataggtttggggttctgaaatttaataggtgattcatttttcattcacaggttaagtttccagacatctgaacaggtaaatggaatttttctagatataaacactcacatgggacaattcattactagcacacagaagaaagccagactcaacttcacattgtgcatgagagcctataagtttataaagatgttgaaatcccagctcctagttttagatacccaatattattcatatattttgaatttattgtttatagtctatctatactttctacttttcatatggagttggaaggtagttgaaaagggttagcccacctttgtctgctccatgatattaactggattttgaatctgtttattagcttagagatgactcttattaacatcagagtataatttgggcaacatgctaaaagagaaaatcagagttcttctgaattccagaatattgaaaacataaatgaagataaatgaagtgtgattcaacattgcaaattcagagcatggaaatagagtggttggttagcatgtgactaaaaagattctgagatttagcagctaatttagccattaggaatagatgtctattgctagactattagttcatagaaataatgatggactttgcatttttccctgctttatcctcagcacctagtatgttgttcaatacgtgctcagtaagcatcttttgacatttctaagcaattgtcttaattcacgccccattcatcatctcatttagaattcgactatcccatccaccagttttggccctcatttcctcatctctatactttattctatagatcagctccaagctgttatcttcctggctatagcattagctcttctctacaaataatttctgactttctaccggcaatgctgctagatttagccatatctgataattccaggtcttcaatatggcctcagggatccttcttcctggtgttgcctttttagacaatcctttaatcatctacattatattgactcaaaactacagaaatcaagagtaaatattcctttcatattcaaatcaaatgagagccaaagcataaaacaatattctagtttcactaatgtgggaaggtgaaagcattttggaggccttgcccaagtgtacaagtaaaaataatattagatatgttaacaattagagctcagttgcaaataacagagaccactctatttgaaacagaaagttattcaatactttaaagtaggagcttaagacgttgttgaaaaggcaggactacaggaatgattctccaaaatcactctaaaatttgccttccataagaactgttacctcttctattatcaggaatctggaatatcaggaatccactaggccaactgctggtaccaggatctcactacattatccttcatgcaggcacctgagggtttccatagcaacgtcgacactaaaaacacatcacttaagctgtaatttcgtgttaagggagatgctgccagaactgctggctcctaagtcacactgtacctgccggttccataccttggagtcaggcagacctaggtttgactgctggttctcttatacattagctatgcaaacatgaaaatattgttttacatctctaagcctccatttctcaatttgtaaaaatgtaaataataataattcatagactttttgtgaaaatgaatgagctcctgagtacagtatgtgacatataatagacacaccaaaaatactagtgacttttctaaatttgactatgcctttaaattgttctgtgaccctgagtgaattagtctacatgtgctcatattaacttcttcatccacaaaatgcatttgatattttcttgctgtttcctctgaattattgtgagaatctggcaagatggttatagaaaaagtacaaagaactatggagtattaggtaatattattttttataggctgttgcaatggagttgaccaaccaggtcagtcaggatatagtcatatcctttataaaatcatttcctattttttctctcactgataatatataaattcagtcaaaattgttcatgaatttattatatatatgggtttgcacctagaaaaacagatgacaaagtagtaagaaaatgatatctatgaagaaagcttaaataaatgagaattatttatcctgtaaagatgatttgcaatgagtttttaagtgtagaaacagggttttgctttcagaatacccaatatatgaaaactgatgtttacaaacccaaatgaggggataatcaatcactccacaagaagattcctcacctctcaaacagattctcttttatgcagagaagattccaaatagaaatcaattaaatttataaaatttaatttgtccaaaacgtttcagaaaaaggagatccatctgtctaaatgtctcttacactatggatgatcaccatctgctttctaatccccactgggcagcaaagaagagattgaattctaaaatgtgagacttaaattgatcaaaggaagaatttcatatctatgtaggctttttaatcataagcatccattaataaaggcaagttatgtaccttaccatatgtcttccaaacaagatgacctcagttttctccaggatagtggattaagagtgtgcctatctgaagactgaggtggatgagatgacctttaaggccttgcaagccctaagaggccatgactttttggagtgcagataatattcggagctgtttgtgaaaagcattaggagagatcttgccatatggaatagattcacaatttgaggttgcatgtagaagagagagtaaatatagaggcagctgaagggctggaagacatctcttcagcaatatgctttctgaaatccaggacacctgttttgccaagttgggtcagaaacctggaaagaatatactttcttgtgaagattttcctggagattttcatgacttcttgtcttcacgtttagcacagcctaacaagcatacaaaggtagagagccacagagcagaaatgaaaagcctaaggaacattttagaagggtctcaagttaatagttcaactaaaattcgacttggttcatttgtttgtttggtcatttggtttagcttgatgagatgatatgtttaagataattgatctttccctcctgaaaacatgctcttagcattatatttatacctctagtagtatgctggtaaatatttagcgactggctctctgaaagaaaacaaactttttaaagctctgatttgtagcatttgccaatttctatggtgtaaattcttcgaccatgggcaatttcagactagcaaaggatagcagttagggcaaaagtgtgaagagttagacattattagtcttcatgatccaactccagcacacatattcatcttccttaagacatttgccactctcgttattggattgtagactcatacatcccttaccttgtctgtttcattgtaaacataagtccctggttcttaggtgctttgtttgattcctccagcactcctaccatgatgcctggcacttgtctagtgcttaactaatgtctatggagagaatgactgactgactgaatgagcttttaaattcttaattagactgaagtccaatgacaaatagtaaaatcttattttattatcattttttgaattttggttgtgttgaaatatggctaaggggtcttagccaattcttgtctactttcttgttatccatatcccaatattttttaggaattgcacagcagtataacccagaaatgtggctccttcccaggtcaatagccaataacaatattttagagtttttttttccttttgtttgtgttttttttttttttttacagagggcatgcgatccaattttgtctacaatatgcaaggaagaatctgttggaaggcttctgtacaggttctcttccaaaatataaagagatgcactaccagaaagcctctcatcttttcatagcaccatgttggcatgtgatgcttagatctgagcagactcctggtattctttagtaaaatctaagagagtcacagagcaactgacccagaaccttgacactgttgatctgctgaattacccaaccccagctgccttcactctgatttcttgttatataagataataaattcatatcgtttaagccattttttattgggtattccattacacacgatctgaaagcctcgtaactagtccactatattatgaattctgcagactcctctaatgttctcatcataaacaagttcttcactggctgatttttacccagtattgcttctctccactttatcatactccagaccacttatagtcctttaaatatggatgcagctttgtgtctttgctcaagcgttttcttgtttttgaacatacaccctatcttatatcaaacctctactccctcaattacactttgattcctcagaaaattctggtcactctttaagacacatattctcaatctactttatcataaagacttccttaatggtaatgcctaggttttcttctagggtttttatggttttaggtctaacgtttaagtctttaatccatcttgaattaatttttgtataaggtgtaaggaaaggatccagtttcagctttctacatatggctagccagttttcccaccaacatttattaaatagggaatcctttccccattgcttgtttttctcaggtttgtcaaagatcagatagttgtagatatgcggtgttatttctgagagctctgttctgttccattgatctatatctctgttttggtaccagtaccatgctgttttggttactgtagccttgtagtatagtttgaagtcaggtagcgtgatgcctccagctttgtccttttggcttaggatcgacttggcgatgcgggctcttttttggttccatatgaagtttaaagtagttttttccaattctgtgaagaaagtcattggtagcttaatggggatggcattacatctataaattaccttgggcagtatggccattttcacgatattgattcttcctacccatgagcatggaatgttcctccatttgtttgtatcctcttttatttcattgagcagtggtttgtagttctccttgaagaggtccttcacattccttgtaagttggattcctaggtattttattctctttgaagcaattgtgaatgggagttcactcatgatttggctctctgtttgtctattattggtgtataaggatgcttgtgatttttgcacattgattttgtatccggagactttgctgaagttgcttatcagcttaaggagattttgggctgagacgatggggttttctagatatataatcatatcatctgcaaacagggacaatttgacttcctcttttcctaattgaataccctttatttccttctcctgcctaattgccctggccagaacttccaacactatgttggaaaggagtggtgagttggaaaggagtggtgagagagggcatccctgtcttgtgccagttttcaaagggaatgcttccagtttttgcccattcagtatgatattggctgtgggtttgtcatagatagctcttattattttgagatatgtcccacctatacctaatttattgagagtttttagcatgaagcgttgttgaattttgtcaaaggccttttctgcatctattgagataatcatgtggtttttgtctttggttctgtttatatgctgcattacatttattgatttgtgtatattgaaccagccttgcatcccagggatgaagcccacttgatcatggtggataagctttttgatgtgctgctggattcgttttgccagtattttattgaggatttttgcatcactgttcatcagggatattggtctaaaattctcttttttggttgtgtctctgcccggctttggtatcaggatgatgctggcctcataaaatgagttagggaggattccctctttttctattgattggaatagtttcagaaggaatggtaccagttcttccttgtacctctggtagaattcagctgtgaatccatctagtcctggactctttttcgttggtaagctattgattattgccacaatttcggagcctgttattggtctattcagagagtcaacttcttcctggtttagtcttgggagggtgtatgtgtcgaggaatttatccatttctcctagattttctagtttatttgtgtagaggtgtttgcagtattctctgatggtagtttgtatttctgtgggatcagtggtgacatcccctttattattttttattgcgtctatttgattcttctctcttttcttctttattagtcttactagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgtttgtgtcccagagattctgcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaggtgggtgaaggacatgaacagacacttctcaaaagaagacatttatgtagccaaaaaacacatgaaaaaatgctcaccatcactggccatcagagaaatgcaaatcaaaaccacaatgagataccatctcacaccagttagaatggcaatcattgaaaagtcaggaaacaacaggtgctggagaggatgtggagaaacaggaacacttttacactgttggtgggactgtaaactagttcaacccttgtggaagtcagtgtggcgattcctcagggatctagaactagaaataccatttgacccagccatcccattactgggtatatacccaaatgactataaatcatgctgctataaagacacatgcacacgtatgtttattgcggcactattcataatagcaaagacttggaaccaacccaaatgtctaacaatgatagactggattaagaaaatgtggcacatatacaccatggaatactctgcagccataacaaatgatgagttcatgtcctttgtagggacatggatgaaactggaaatcatcattctcagtaaattatcgcaagaacaaaaaaccaaacaccgcatattctcactcatagatgggaattgaacaatgagaacacatggacacaggaaggggatcatcacactctggggactgtcgtggggtggggggaggggggagggatagctttaggagatatacctaatgctaaatgacgagttaatgggtacagcacaccagcatggcacatgtatacatatgtaactaacctgcacattgtgcacatgtaccctaaaacttaaagtataataataataaaaaaagacttcctttatctgcagtaattaattacataataatctgtgttccatactataccctgtatgtactgctgtcatatttaagttattctttttttgtttactactttactattctctctctctttttctctctctctctgtgtgtgtgtgtgtgtgtgtgtgtgtggatacgtgtacaagcttattttcttgagtttattagtttggtgcctggcacatagaaaataccctatcgatgtatttaataatattaggaattttaatatgtgacgtcccaattcttgactttaggaacgtttttaagggcttcatgtcatatttcattttgtgacacttaaaaggccatctttgcaatacatataaagagcttctcccaaatcttgccaccatccacatgaagctgagtagttattaaatttcacatttttgttattttctaccttctgtagaagcatcagaaagactcagcaatgagccactgccattcctcccagcctgatccagcagggttttgattcctgaagagctagctctttaccagccttcagcattaagacactttattattattattattattattattattattattattattttaactaaagcctgggatcttgagtttaaaaacatgtttggtgcaaagttttggagttccaaaggccaaagctgttgtatgaggacaagtttagttttgggttctccaggtaacaatgaatcaggattctgccttactctctcatgacaccctgggaaggtggtagatctccaaagggaaataggcactagacaccttggcacctactgccagccaagaatccctaggaccaactttgaaatgggaacaacagagatccaagactggaagcgaccatgctgactcaggaaattagtgtttgaaggtgaatagcatggactaaaagccaggatgcttgtcctgaatattccagattgtgtcaggctctcaaggcctgggtaccaccttgggtaagaagagagctccaataatgactgtaattgaggcaggataaaggactaaagtagattaaatgattgtacagaaatttaaaatgtggcatttttttttataccccaagttgcttagtatgccagttgtgcaggagaaaaatcgagttgattgcaatatatacaagctcatattgtctttctgctgcaagtttgcttcaacttattggtttaattgtagtcctgaaggtatatatctatgaggtcatgattctcaccttgaagaggtgaaggatgagttcccctttcctggaaagtttgtcattcctatttgtattttctgatccaccagaaaatgtaagcacaaaaacacaaaattgtgtaaaagcatcagtaaaatgtgagtggtgggatagaggaaatttgcatttactgtacagcaactatatacctgacacttgaaatgcattatcttacttaaatctcaaaaaattctgcaatgcagctattcatcatcacacccacagatgaaaagcctggggctaagattaaagagcttgtcaaaggtcattcacctaggaggtggtagcaacaaatttctatcagaggctgatggatatattcttcttccaatacaaaaagaaaaatggaaacaaaaacaaaaagaagaaaaaaactctcttgtgtgtagagagtctgaaattcagagaaacggcttagcagtatgtcctttggaatgaaatgagggaagtttgcagtttgttgaacttgactcagtatactaaatcttacatcattcctgggatgccatttctgatggattcaccatacacaggtcatataatcctccaaatctattgtgtgttgattcttcaaaaaagctgttactaatttcttttccggcaaattgtgatgcatgcacttctcatatgtagtgttaacagagaagataaaaatcagtttgtgggccaggtgcggtggctcatgcctgtaatcctagcactttgggaggccaaggcgggtggatcatgaggtcaggagcttgagacaagcctggccaacatggtgaaaccccgtctctactaaaaatacacacacaaaaaaaattatccgagcatggtggcgggcacctgtaatcccaactactcgggaggctgaggcaggagaatcacttgaaaccggaagacagaggttgtagtgggccaagactgtgccactgcactccagcctgggcaagaagagcaaaactccatctaaaaaaaaaaaaaaaatcagtttgcctcaaacatttaatcctaactaactcagcctaggtgtaaaccaattcaaatgaattaaaactaattcaacaatctatctaaaagatgcccttaaagacacaatacaataacctacttaaaaacaatttgaaaaaattaaggaaacctacatgtaggatagtgataaccttccttaccaagccatttcaataatttttaaaaagcagacagctctcaactcaataggtccatatataaaatggtgaacccttcccaagtgtctagcaaatgtacaagtagaagaattttatgcaattatgttcaggaaatattaaaccttaattaatgtattggtgatttcaataataaaatgccctctgtcgtctaagaacaaatggaaagcattaaaccaatggctagatttatggctaaataaattaagcacattgtcaaatttgtcagagaaatctttccacctatatgtgcccttggttctagagacctccctccccgaacgccagtcattctgtcaatgatgctctgcactcgtgcattgtgacgattgcaatacatttaaattatacatggggcattttccggtgagttgtgcatctgtaaagtgaccagaggtacagaatcccctagtttgcctaatctactcacttgtgtacatctgtgcatgtgcttcaggggtattagattggagattgggtgggaatatggatgccggggatgctgagtttaatggaggagagaagcagctgcattgaaacataggaataacaaagagccaaaaaaaaaaaagattttttttcttatgaatatatttaacgtgttaaacagattctggcaatttcctgatggctccaaaagaagcctgaactgagattttcacagacagtgttccaggccctgaatactgtacctcgtgtattgaatcacatctgctacagagaggaagcaatgaataattaactcggcctccacattactgccatagattacagtcatcttgactgctggactaccctgcacaacataaaccatttagaaaactcggttactctctttccttttaaatttgtcttgctaacacttactgcttaaaagggtaaatctttctctagttttaattaaagcatttaaaataatttacattgaaatcatatgtgcttgggtctgtcagaattgatgctttaataacatgccatccctttctccattgccctgaaatctgttaaaattaccactaatctaattgggaacaaagttgtcaaatgcatgcagctctgacagtttgtctttctgcaaactgccgacagattgcaagttacgcatgtgttgagcagatgggtaagttaaaaggaacaccaaaaaaaaaaaaaaagcaatttattaaatcacctggaaccagcagcttcggtccaaaaatagtgagaatgaaatatagcaggagctgggagtgctggcactagaatataccagaaggtaccggttacaaaacaagataaacatttggagatgcctcagctgtgttacagaataatgaggagttatttaacccgatatagattaccagccaaaattaatttagggtgcagcttttttggaaaatggtttgcaaagtgattgccttaaccctttcctgtcttctcgttatcacaggaagacaggcatatttttctccttctttcgttctcaaaggcatcaatacatattcacatacatatatgaacctacacctttgcacacataacacactggcatacatatgcacacatattcatactcgtatacacatgaatgcatgcacatctgtgacactaatatgtatgtgcacacatgtatgtaaatacatattatctcgtatataggtaaacaaccatgagatatatatgtacataaatattcgtatctatttatccatctacctatttacctatctatgattatattcatgagagattgttttgttttccatcatctgaagcaaggttctgagtaagccatgcatgcatgggttacccagcctatagctgctgttatcataattgctctctcgtgttccattagtaaactgtccaggcaggaggtagggaaaagccaaggtaagcatggggtaggaggagagtgagaagaacaggagctgaagcctgagagcctctctcatgggtctccactgctacgccatgtgatcagaactttttgttttattttccttttatttttgagacaaaatctctctctctgtcaaccacaatggagtgcggtggcacgatcatagctcacagcagcctctaacccctgggctcaagctgatcggaacttttgagaggtgttctttaaaaacttacttgcaaggagccaataaaccttaagacccaagaaataagaacaaagaagacatgttttaactaatatttctctcacttaggtgacttgggtctgtaagaaatcatcaatttaagttttaaagtgcaataagtctgaaatcaagatattttctgtctctactaggagccagaggcccagcaatttaactctctttctcttcctagaacaggccaacacaattacttcaaggagaatctcttgctggaaatttaggtgatcagtgatgaagagccaagaactgagtgtgttcccaggtccccaagaggaatgcagtggaattcagatattaaatattggtgtttttggctcgctccccttatcgctttacttgcatctcctggggatgtcatccactttcatagttttggctgccttatagtctaatggcttgcaaatctgtatctcttgccttggtttttctcacttggagtcagattctgatatccaaataccggtgacaaatcaccatgtaaacattcctcaggcctctcaagttccatgagttcaaaacagaattcctcaattctttcacaaacttgcttctattcctgtgttcaccatgttatttgttcatattgcttggcactttatcattcacactagaaaaataatctatgaaatcagagaataatccttaaatcacctctgttatccactagccatagccactcaccaaattccaccagttttgacatccaaatgttcccataaatctgttctttcccactctttctctaatagaacatctctggcttaggctttcttcatctcttgtgtggctatcaggttaggtcttcctttccagaatttcatatctcctatgatcaatttccacatagctgcaagggtggctcatataaattcaaaccagaccatgttcctttcctgctggctctgctggactttctatgttgccccagcctatctgctttctacctttctcttctgtcacccgaggctgagagagaggcaaactctatttctcccatcctgtccttgtcaggccacaaatggacactgactgcatttttctcctgaaggccacagctcctgttgtgttactttcttcatctatagctttggctggagctgtctccagattctagtaagttctttatccctttgtcctttaaagccaagggaggtattatctcttctctgttgctagccctaggatgctttcctaggtcttgttagtttccctttagccctgcccattcctttgtaaacagtcccttcattacaatttcctcaattacatttttgtaggtgccatctgtttcctcccaaggtcccaactgatgcatcccgccattgccaaaaggatgaaaatttcaaattcattacatggcaaaaaagcctctttaaaatctagcccttgccaaattctccagtctctcggcccctgccctcacaggctcacgtgtttaggctccccacatacaccattactgtttcacacctctctggttttcccctgccctttgcttgaaatgtcctctcagccccccaggtccttgccccactctcagcttcgtactctttctggctcttacatcttttcccttaattaaagatgcaacttaggcatcactttctccagaaagtcttccctgaacctctagtattcccaccttcatccacagtcaaagttttaatagactcacaatgaatattacatattcaaggctctgggaatttgcttggtaaggtatctgacctcttaaattaatttccagattctttctttcgttctttcttttgttctttctttctttcttctttcttctttttttttctttctttctttcttcttttctttcttcatttctttcctttctccttccttccttctttcctttcttcctctttttctttcctcccattcttctttcctttcttcctttctgcctccctaccttcctttctttctttctttgttaaatttactgattatctcatttaatcctgatggcaatcttataagttaaatcctattattatgctgtttttaattaaagaaagataaacttaagaaattcaaatgtcctattgaatggcaaacagctagcaagttaaggcgctaagacttcaatgcaaagttttactgtagagtctgtacccttaatgataatattaaaggcaagatttggttatgtctgggtgttacttacagcatatgtgtgaataagtatatacaatccttgcttataaatagtaagaactatataaggtttatcaaagatagagagccagccaatatatgttaatttaatagataaatgtagcattctgcttgcaagctagggataattttaggagccctcggtgtggtatttaagataccacaagttaataatatttgctcaatttttcattttcaagatggcagtttctcacacacaacttgggagtaaaataaatatgaaggtccccaaaataagtattagagaaagatagaaatagtaactacgtattttttaacaaaactcaaatattttgaacagtatgttcctagcctgggagtttcagttgtccatagagagaaaggcaaattcacaggcaaaatatgcaactattctgagacctttgtagaacaaagatctcccgttgctgtgatgattatcatcatcaactaagcagacaagttttgatagaatgcacagcagctactgaggaaagaagggggaccaactcggcaagttagattcatggttcaaatcctcaacacattgatagacgtcatggccatacattataatttactaatatcttaactaccaaataagaggaacagtacaaaagtacttatgtaagctgaaatgcaaaacgcaattggaaggcttcattatatttgcccattagggtaatatgcagttaaaagactatatcaaagctatattatcccccatgtatccactcacaaatgcaatctccagtggttcccgagcaaagtatacatcaggatcaccagagagactctttaaaaacacatacatttgtaattcaaaccagaagattctgattcaagagttctgaatgagcactggcttttatatactggaaaatctctctagatgaatctaatatctacccatttattacgtagagtaggctaggttgtgctgcagtaacaaaaacaaacccaccaaaatatcaatgacttaacacaacacaagtttatttttctctcatgccacatggatttttcatcaagttacatcctactatgaccataacagcagtgggaagaagatggatcaaacactgcactggatcttatagcttctgcctggaagtgccacttctctcattccattggccaaagcaagccacatggcacatttaacttaaaagtggtagggaattcttaattccaccatctgcctggaatgagggagacctggaaatatttgtgagcaacactaatggaggccaaaatctctgattaagaaccatgagttatgatcagtttctcaaagtatttcaagtaatttaacctacttctgctgccacacattcttctcttctttttaaccttttgtcagaaattttcaaaatacaaaaatgtctttaataataacttagggtttgtgatttatttgatggcagtttttaaaaagatgtttttaatcctacttagaaacagtccactttcatgatttgttgcaattttctttccctggttaattaaactcatttcttaggaaatgactcatggcgaatcacactaagaataaaattagtcacattgccctctttgttataagatgagtgtaaataatctttaaggaaatttttcttaaatcaaaaaagcatgtaatagtccccaattcagtaacattatgtaaaatagcagactcagagagtagtaaatccagatgctgtcctattattgcatgaaacaaggcagaaatttgtgttcctttattgttaaaccaggctctatccattgaatttctttatgtaaatactcttttggagggttaaagtaccattacaaaaattcctagactaaaacctgttgtatggtttctttgaccactggagagatataaaaccattacatttaagtatcataatagctagcatatgttatttcttagaaatgacactaccatctggattaaggtctactgatgatttcatacaatactccagttttcttcgggtagagagaggccaaactgttttgactttaactaccctgttgttctaatgaaaataataaaaggttacacttatgtctgacctacttgctggagatcacatactgccttattaataaataatataattattatagtagctgaaaatgcagaaggcaagccagttgcttgtgttaataatgtgagttggggcccaaatccatcgtccaatattatccatttctaaccaaacagatcatgcgatttccctggttgccagaagcacgttctgtagtgaaaagtccacctgccttgtgttcaaatcttgcctctgctgtgcgctaattgtcagacattgggcgtgtttctgaatctctgaacctcaatttcctcagctacaaaatgagaataattatatctatggtaagtttgttaagaagcttaaggattatgactataaaaatctctagtaaattaccactttcccaacgtaacaggttagaaaaatcagagtcactattattcctaagttttttttatctgcatggtcatctttatttccttcaacctgtgcaaagagaagcaagacaagattaaaagcaaaagtatggtcagaatgtgaaataagtcaaattggaaatgtgataagcaaagaccgtattgcacattatgtatctattcctggaatagctttctaacgtggtggaatcactagacaataaaaatacactcctgtgtataatgtgatagcggtatttgttcatttgcatgtaagccaccctcatggctggctatctttaaaggtcatttggtgaactctcaccgaaaaaaaaaagtgtaatctcttttactcactgaagtcatgaaatacatgaatgagtgaaatacatacactgaagtcatgaaatacatggggggttgtggtggaaaacatagaagggtggaggaaggggaccctctcacctgactgcctcctcactggccccttggctactgtcacgcacacagcaaaccctctgggccaatccatctgactggctgtgcagggaatggggcagcctggataattgatgggctcaatctgaccaggcacaggtggcacagagacggcgtacagcagcttctcgggtttgccagtgccatctgttgccataaaaacatctgtcgtcaaggtcaccctgtcaccctctgttaaagttacaggtttggtgagtaggataatgtcacctaagaagaagggttatgtatgctgggggctgggagaaaagagaaagggagaccaagatacacaatgacaacaggaaatctttcttttattttaattttgaaagataaataataataatagaattactgaattgaaaaattagaaaaagtgcacatgtttttaaaggagaaccttataaaaggcttgcaagattattgtcattgttcactctagccaaaacattagctcattttaaagaataatagcatttttatcaaagacatgacatgtatttgtaaaggaaatatgatatttacttgtaaaaacaagcactttcctttctgcttgctaactttaaaaaccattttttggtatgatccttttgtataagtacatttaactaagcatctgtgtgtgtgtgtgtgtgtgtgtgtgtgtgtgtgtctgcattcacagcatgttcagggagggagtagaatggaagggatggaagggggcattgcatttatcaaagtatttaactggcatttgagctttgctctgctgccagaaagaatgacccatttgttaataaagaacaattaagttaatagactcaaatgatctggtggacaaagtactgtaatgaagcaaatgcaatattggatttttaagcagcaagtattacatgtggccggacttccagcagcaatggctcatctttccctgtctgtgtttgttgctgaggcgttttaaagcaatttcacccagtggcaaagaaacatccttcccatctgtttaagaagtgcggctttacttatcggacaaatattgctggcaccatgggctttcagggacttactgattatcattgaatggtgagatgagaaggggaagataatctgctggattttgtaaaacacactcacatctgcccacatcaaacctaaagagtactacattaggacaatacagtttctcagcagaagggaaggtcagggaaggagtagacaaaacagcagatgaatatgctttgtttcatctgtacctgcagcctggtcaccaaacaccatgcagaacattaaagtggagctcttgggaaaaaaaagcaaaatatttatggccaactgtaattttaatgttgttaaatgtgtggagggtatatagaatttagtttgttccctgattcaatagtttaatgttttggtagtataaatatgatgattatctggcagcaatttcctctaatttgggccactatgaggatcaccttttcctgaacctctggtcccagtctgataagacaagtaatgtaagtaaagaccaaaaacttaattcaagtaaagggttataaacattggtttctatgctctggatttcaaattatttagtgacatacatttaaatccatattccaaatggaacaaaggattatttcaattatttggcttcatatggttcacaaaaattaactttccttgtagtcgtttctttttgattccaaagcatattaatattatcacattaatttcaagaggactttcataactataatgcagttgataaacaactggacttggactgctaactgagtatatggccctaggaaagtcacttaatatctcaaaaattctgccacaaacttcccatccaattctggattccttaagtacaacttatttgcatgtgtcttcctccttctagttcataaaatcaagtcactctcctagttttctcatttgattccagtatcttagctcattcttctcttgccagctttatgccctagttctgtatcctgtgtttgacatttgtctctggtccctccagatttgtcagtcttagcaattgacagactttgcaccttgttaatatagctcataggggaaacaattgagcatcttcttttgggacatgggctttgaagttactgtgagcagttggccacttaacctgagtgaccttagggaagtttttttaaccttctcaagactcagactgctcatctgtaaaatagaatttaaaatgataattatcatatagaattcttgaggattaaatgcctgacatacagcaagtgacatatcaatgatttatgttaatattaccaatcattagcttaaaatattatccaaaactgaatgttgttatttattgaatataaatattttcaactcctggcttaatcctggaaacttcacctcatgtggttccttaccccagctgaaagtcaggctaagcttgggtccctaatacattgtggttgatttaaataaatatctcctctgatctctaagcctggaaaatgtggggagaattttctatgggtgtttctgggtctgtactagagtgcccaaaggccttcacagaagtaacatgcttcactgtgaaaggataagactacaaaacagaaacacttttcccaccaaagctgccttctcttaactgcttggcttctgtgtaataaatagaccatttgaaatattgttctatagttaacacatttgaaacctgctggatatggtagtccccaagatcagcattaatattgtaactcctagactatgattaaatatattcacgctaacctatcagaggaagcaatagaattaaaacataatttattattttccttgatgatttaaggagttcattataaacacaggagttctgaagtgctgtgagaagataactttagggtactccgggctcttttgtttttcctatagcaaacaacctcagactgtatatgtctttgaatgctcatgtcattcagatgtgtgtttctcttttgccaactttctggcctcttttaatttgctgcttctagtgtactgttagaaagacactaagtaataaaacttgttagttctatgtgaaaactgagagtgataataccatgagtgagaacatcaagaactatacttagtaagacacttacatggattttgtcaattggcttctcagtggctttacttaatggtctcattttctggatttgggctttgttctctataggaaagatgagctgataaatgtttaaaaccaggggagtggacgaatctcaaatttgtagcatttgctaatttccttggtgtaaataatctcaccaggtctgatttcaaactaccattgtggtatcactaaacacagactctgtgaaacacagaattaggaagagacaaacataaatggcctgctccagcacactacttactgtattgaagatactgtctagtaagagacttgtgtaaagtaacctgctaccctggtaacattagcattcacctgaatacttaaaactactagaaatgtgagatctcagaaagggcccattgtagaatcttaactactggttattacttgtacagggattgagttctttgttaatttaacgtttattgatagcttatgtgtcctacatactgtgctaagcacttgtgattcagctcatccaatccctataataaccccctgaaacaagaactgggattaactacatttttaaaatgatgaaactgaagctcagaatcattaagtaacttactcaaggtctcacaatttttatgtatagaataggaatataatttaggaagtcttgttgaaaaccccacatctttaaccactgtgaaccaactttgtaaataacatagcacatttgacttgtaagtattttctaacagataaacatgtgtctagttgatgatcatccattcgtttcctgacatggttttagcacataccttgtaatgatcctgttagtatagggccatgaaaaaggttatatgtaaatttgttatttagcaaagaaaaaaagagagagatataaaaacatcaaaacttataaattgtattttgattctttcatctgtatcctctttccatatttctttttcagttttttattaaatttgaaatcttaattactatgtaagttatatagcatgcctagcctaagctaatggctataaaaataaaaataaaaacaaaagagcaaatgaaagtctgattatttccatcaatgcccattaattcaaaaacaccataatagaatattggtttgcaaataatatgccagtgaccatcacatagccacataatttaagcaactataagtgcaacgtcatattatagaggacttctaatttaattgagtttaaagtaggccaaagtcggtcatttatacttctctgaatagattataattacttcccagaaaataaaaacaaaacattcagaaggataaccaatcttttctagagatgaaaatatttccttcaatgacctatttcaatgtgaatccactggcattaaaaaaagcagtgcaactgaacgttattttttaatcaatggttatggataaatctaagttaatattcaataaatcgtctccctttaaaggtggtccagcaaaacatttagcttttgcttgatgcagctcttctccctgacagtgattctcaattacctagttttcctgtgtatcaaggaaacaatcaaaaactggattaaataggaccttaccctcatgcactatagtcattttcaaataaatgaactgtgtgtgtgtactggcatccactttgccaaaatggtataactctaacctcagaagcacgcaccagttagcagggtctgcaaaagttcagctggtgagggagcacacattttccttcttatcccacatccgttcactgccaattaaaaacaggtaaccctataatctgcttctggtagtaccaagctaattagactttgacaagaatgtagcaacgcccaatcgcagaaaattaacacgcatgtttctctacagatacttggggaaaagggagaaataaagccacatgcaaaatctttccaaaatctcagccagacctcatttgtgtccacatacttcatgtcacattaactcacccaccctgatgcccagaactacgccctccagctgactggcaaggttaggctttagctttttaataaccatcttatacatatagacctatatatctaggatctataaagcacacagatgattatttaggattaatggatcattcaaagtgccagttggcacgttttgagtaaaaagtgtaacaaatgcagctgtttactaataaataaagcctcagctgtaagagaaataaattagatgcatttaattggtaggctgcaaacctcccctttattacaatgcagcttcttgttattttatgatgtcagggtagatggcagactgacagagtgtttatgaatcacagtttgcagatggcactcttggttttcagcagctatgagcacaagtagcatgaggcctcaatagtggattttgccaaagacgaccccctgagaattagctgtcttcatttctcttgtgccaatctctccctggcagaacccttacttcacaaacccacctttaataaattgtggctgcctggcagggaatcaaagagagctcacacccacagaatgccctcatctcgaggtgatctctttgttattgctgaggaggcctgtgcaatgattctcagagcagacttcctgcaacttcatacgaagatgaccaaggatcaggcaggacagaaaccctccccctttcgactccttggctttctttgcccactctccttgcagctgacagaagggatttcctatctctagagcactgcataaggtccttgcacttgggattcagagctcccctaactaatgacagctttgtcatcatacagctggggaggggtcaccccaacccatggagctgaggcttcacagcgtcagcactcctgcattcccctgatgaccattcacttctatggctgggaacagcacacaggagacatgcagtcataattgtcaacagatttgtacattttcatcaccagttatactcctaatggatttttattctaatgggctgtttttactttattagaaaagtgagaggatcaagccccttttcacggaacagagtttagtctgaatgtataataatagtaattataaggttaatgatactaatagtagtaatactaatatcagaagctaccattcgagtacttagtatgtgataaaatagaataacttcccataggattatttaagttatcttatgctagtttaaaacacataagcaccattccctttctctgcttgtttccttttcctacgttgctttggtcagacacttgagtcctggttacgtgtccaggaggacctgagagaaatcctgagattgcttcctctttttctactgtgtctgctggaggcctgatggaatgaatatatctcttcagctatcttatgaagctgaaattaaaatggctgctggtggtcaagctggactaggtagagaaaacatacaaacaaaaatgaactttgttggttggtattaaaaacagttctgaaaactttaagtgggaaaggaattaaactcagattttttactttagatgaggactcctgtctcataataataaaagaggttatttaaatccttttaattaaatttcatctatgttatgtaaaatatgcatgcatttttccggaaatcaagcagaaggcaaagatgtccactctcattactttgacatagttctagagttcctaggtggcataataaggcaatgtatggatacatacaaacataatacataaataaatatataaaattgaaggcattcagattggaagggaagtcataaaactatcttcattttcaaatgacatagtcctgtaaccaggaagtcctaaggaatctacaaaaaaataacaaatgaattcagcacaatcaggatataagatcatacactcacaaaactgtgtttctatatactggcaataatgatccaaaaatgaaattaaaaaacaatttcattcacaatggtatcaccaaaaacaaagtattggaaatacagttttaagaagttgtgtcaggtttgtacattgtaaactgtaaagcattactgagaaaaattaaagatctaaataaaatgagagatattccatgttcatggattggcaggctccatattgttaagatagaaattcttctcaaatttgtctacagactcagtgaaatttctagcaaaattctggttttttttttaacagaaatttacaagctgattctaaaatttatataaaaattgaaatgactcagaataacaacaataagcaaagttgaaggactcacattttccaattacaaaatactataaagctacaataattaagagagtgcgataccaaagtatggttagacatacgtatggatggaacacaatttagaattcagaactttactcttacatttgaggttaattaatatttgacaaagatgacaaggcattttgatattttcaggaaacaatgctgagataattagatttctgcatgcaaaaagatgaatttagatgctaacctcatatcatataagaaaattaatgcaaagcagatcatcaacacatctttaagaattaaaacataaaacttttagaagtggttatagaaaaacagtagaataacttgggaggaatagagtttttctgagaaggtgatattgagcagaaagctgattgaattgaactctaattgattgaagcaaaaatctggagaaaaaatattccataatccaggcagattgaatagcagttgcagtacccaaagctcagggtaagatatgcaatttttcaagaagcacaaagaccagtatggttggtttcattgtgacattaggctagacaaagatctcttagacataaaaagaattatctattttaaaaaaggataataagttggacttcatcaaaacttaaagttttgatcttagaaagatatcattaagaaaataaagtgttgcatatcattctaaatgttgtgaaaaagaaatttttaaaaaagaaaaagaagtgttaagctgcagaccagaaaaaaatatttacaaatcatattgacaaggaccttgtatcaagaatagaaaaagaactcctacaaattaatgatcaaaagacaaatagctcaattcaaaaatgggcagaaggtgtaaacagacacattacaaagaagatggtgaccaatggaaacatgtaagatgctcaaggtcattagttatcagggaaatgtaagttacatgcacaaggatatattactacccattcactaaaatggccaaaattaaaaggaatgacaaaaactaagtcttgtcaaaaagtgagagcatctggaacattcatggatttatgttgagagtataaaatactatatctattttgggagaacgtcagtagtttttaaataaagttaaccatacactactacttgtcccagtaattctagcactaattagcttctaaacagaaatcaaaacattttgtgcatgaaatacttgtacacaaatgttcgttgtagttttgtacataatagctcaaaattgaaactatcccaaatatcatcaccaggtgaatggataaaaataattgtggtctatttatacattgggttattactcattaattaaatagaacacactactgattcatgcaacagcataaatgatttttccaaaacagaatgattcttcaaaacataattctctaaggcattatactgattagaagaatacagagtaaatacagtgtgcttccatttatatgaaattttaaaataagcaaaactaaagggccaaaaaggaaaacagtggttgtctcgggctgaaggtggagaaattgactgaaaagtatcttgaggacactttttggaatgatgtaaatattctgtatcttgaggggcaagtggttacatagggtttttttcatttgtcatatcttgttaacagtacacttaaaataattataattttttgcgcttaaattatacctcaataaagctgaaataaaagtaaaattaaaaattagcaacattggcataaaaagcgacaaactggaaatgacaagaaatcttaaaataaccttacttctaagacaagcactgtcttagttttttggggttgctatgacaaaatatcataaattgggtagcatataaaaaacagaaattttttctcacactcctagaaactaggaagtccaagatcaaatctctggcaagttcagggtctagttagggcctgtttcctggttcatgaatggtgccttcttactgtgttctcacatggtaaaaaagaagaatgagctctctgattctcttttataaagacactaattccatttttgagggctctgcccttgtgacctaatcacctccacaaagacctcgccatcatcttgggggttaggatttcaacatacaaattttaggggtccacaaacatgcagactgtagtgtttcaccttggccctccataattcatgtccttcttacatgtaaaatgcatgtattccatccctatagctccaaaatcttaattcggttcatcatcattttattagtttaatgtccagagtctcttctaaatatataaatcaatatgagtgagtttcaaagtacagttcattctaaggcaaattgctcttcagctgtgaacctgtgaaatcaaacatgttttgtgcttccaaaatactatagtgccataggtataggaatggcattcccatttcgaaatggaaaaatagaaataaaagggattatgagtcccaactaagtctaaaactttaaggatgggaaataatttgttttggtttgatgctctgccctccaatcttactgaggcaaacatccggcctcctcagcttagctgattaggagttgagcccccaagactcccagccaaagagctttgaggaagtaatggacagcaagcaccaatgtcttggcctcctttgaaatcattattcccccaaggcccgtgatgaaagagggagaattgaagattctgaaatgccttcagtatgatttttccgttatcttgatgaataagcaccttgctgatctacactaatctcctaatcaaatggtacacactcttggtgttctctctcaaacacttcttattttgtacaataatgagcagggcacagtggctcacgcctgtaatcccagcactttgggaggctgagacgggcagatcacttgaggtcaggagtttgtcagcctggccaacatggtgaaaccctgtctctactaaaaatacaaaaattagccaggtatggtggcgcatgcctgtagtcccagctactcaggaggctgaggcaggagaatcacttgaacccaggaggcagaggttgcagtgagctgagatcgcaccactgcactccagcctggatgacagagcaagacatcatctcaaatatatatatatatagatgagctgagaatttccaaatgttcaagttctgcttccttttgattaaaaattccatcttcaaattgtttatgtcttctcgtactttactataagcattcaggagaagccattcagcaccttcaacactttgcttaggaatttcttcagctaagtattctatttcatcactcaaaagttctacattccataaaacactaggacacaaatacaattcaatcacattcttttttttttctgtgtctactagtgttttctttttttcttttttttattatactttaagttctagggtacatgtgcacaacgtgcagttttgttacatatgtatacatgtgccatgttggtgtgctgcacccattaacttgtcatttacattaggtgtatctcctaatgctttccctaccccctatccccaccccacaactgccccagtgtgtgatgtttcccttcctgtgtccaagtgttctcattgttcaattcccacctatgagtgagaacatgtggtgtttggttttttgtccttgcaacagtttgctgagaatgatggtttgcagcttcatccatgtccctacaaaggacatgaactcatccttttttatggctgcatagtattctgtggtgtatatgtgccacattttcttaatctagtctatcactgatggacttttggattggttccaagtctttgctattgtaaatagtgccacaataaacatatgtgtgcatgtgtctttatagcagcatgatttataatcttttgggtatacacccagtaatgggatggctggttcaaatggtatttctagttctagatccttgaggaatctccacactgtcttctacaatggttgaactagtttacggtcccaccagccatgtaaaagtgttcctatttctccccatcctctccagcacctgttgtttcctgactttttaatgatcgccattctaactggtgtgtgatggtatctcattgtggttttgatttgcatttctctgatggccagtgatgatgagcatttttttcatgtgtctgttggctgcataaatgtcttcttttgagaagtgtctgttcatatccttcgcccactttttgatggggttgtttgtgtttttcttgtaaatttgtttgagttctttgtagattctagatattagccctttgtcagatgaatagattgcaaaaatcttctcccattctgtaggttgcctgttcactctgatggtagtttcttttgctgtgcagaagctctttagtgtaattagatcccatttatcaattttggcttttgttgccactgcttttgatgttttagacatgaagtccttgcccatgcctatgtcctgaatggtatacattctttaccactttataacaatgatggcctttcctccagtttccaataatgtgttcctcattttcatctgagacctcatcagaatggcctttaccatctatatttctcccatgaatatattgttcatgtccacttggatattctttaagaagactgaggctttctgtatagattttctctacttttgagcccttaccagaagaattatcacttattcatagcaacctaggtttttactagcatgcacatcaaaattcttccagtctttactcattagctagttccaaagtcgcttctacacttttaggtaacattatagcctatccttctgctcttgcctggaacagaagtgtgttgctggaaatgaagcaatcatttttcaaccatgaactaatgacatgaggatgaaacccacactaaggatatttgagaaaaatgttagaaaatttctgttcctaatgtcaacaagggccacatcaaccctgaactctaactctcagcttcctcttacatgagaatgataaatttcttatttcattaagctactatagttagttttctgttactaggttacacaaagaagaatgcaattcctaactgataaaatgcttcaaagctgctgcaattaaaatactgcacatcatcatattaatgctaaaataggcaagtacattaatggatggtccagaatttatacttgtataaatatacatatgtattatatttatctctatgtacattagtttttattataaagtaaacatttaaaatcagtactatgtgttgagttagttcattcaaagtagccaacagatgaagaaagagttcagcaagatagatttaaccatctttggaagtcttcctattccaacagccagctcctctctgtgtctgcacagccccatagtggtctgcatttttggatcacggctgctctctgtagactctgcctctcatatcacagaacatccccagttcattgtcctccattactgaatctgtacccgcttcgttttcatcactgtctgccccaggtgagtcttcgtcctgcccttcctcaagctcgtgccacatgatccttaacattgaacctttcacaattggtaaattcttgctgcttgactctttaattcaaaagtcaattttcttgataatattcaggactccatcctctgtactcttttctgccatccatttatgttgattgattaggtcagaaagcccaagcttttcatttagttcttcttaacacccttgtcatttaagtccattagtattttaatagtggattttaaaatattatattaaattttattgctttttgacaaaggcagctcaagaataatttctgaataccttatagaaaccataaaatgtcagagctgcaagggcccttagagatcatctgctattactttttattttacagatggagaaactacagcccagagaggggagtgattttcccgttgttgcacatctcattagtgaagatgttaaaggtaaaaccccagaactttcttgattttcatcttaatctccacttgtccaggttttatttcttgctattggaggcgccaccctccaattttttttacatgttttataacgtaagtaatctgttagggcaaaacatgcaattctatatagaacaaatatgcatatatggggaatgagttcttaaaaacatttattcactagggtaagtgataaaacaaaagtttggagaccgcagactttgaatttcaaattcttagtgtgaaatattagtctatttattaggctatttttttttttgagacagggtctcactctgttgcccaggctggagtgcagtgacacaatctcagctcactgcagcttcaacctcccaagctgaagtgatcctcccaacttgacatcctaagtagctgagactaccaactcatgccaccgcacccagctaatcttttgtttattttttgtagatacaaggtctcactgtgttgcccaggctggtcttgagctcctgagctcaagcaaccagcccaccttggcctcccaaagtgctgggattataggcatgagccagtgcacccagccccagttactcttttggttagtatttattgaaggctattctgtgccaggcacagtgagaggcaacagagaacattattgaacagaagcagagtcttgatcctcacagaatgcactatctagctggggatagaggaagacactgagcttgtctggaggctcagggaacgcctccttcaaacagtggtatttgagttatgaagtatgagttccttctagtcataacaaattactggaaatttctggaatttctcaaagtttcccactaaaaacttgtaggagttagtcccactgtcctgaaatttctcacttcagaccccacgtccactatttcatcaaatttttcattctcatcttagattctgctgggggcctcttcctttttttttttcttgctaccttatattgtaacacccacatgttataatcttcgctttattcattggccttttatactcccctgtaccttgctcttatttcctattgacagcatattaattagagcagaatatgttgaattgaatagaagctctctaatggtcagtcatatcaaactgttgtttatgttatttatttgcacaaatgattctctgttcctagaaaattcttatttaggtgtttgaatctgagttaccaaaaaaaaaatttcaccctcctcttgggccacatgagatgttctttacttttctctaaacattctagatcaccagagtactagaacattccacagaacaagcaatatatggtattgtaattgtgtatttggcggtttgtctctacctcaaaatcatgagccaattgacaggaaagatatttcttactaccttttaattccaacgtccaatgctgtatctagcacatagtatgtcctcaaaaagaccgtttgaattaaaggataaaaggtgattgtttgaattaaagaataaaggaacacacaatactactgagttctatctatgaggaagtaataagagtatgatgggaagcaggttctctgtgtatgcatgtatatttatgtatgcatatataaacagaggtaccttcgttttagcataagactcagggtcttaggcaaaagggagactgacaactaatgtatataatctgaagttttttttctcttgcttattgtctatcttccatatgagaatttaaagttctgtgagacagaggctttgtcttgtttatttctgtgtcctttgctcccaaacatgcctggcccatagtaggtgataggtaaaaattgtcaaatggatatagaaataatgcttatttaagatttaatatatgtaaatagtttgtcaggaatcctgcatgtgcttcctcattaagacctcaagatcatccaatgttagagatgagtagcagaggccaggcaagagacgtgacaggcccaaagtcctttggctcttaagtgctgaggcagccattcaaactcaggactctctggtcccaaagactaaattaaaattgaagctcaataattcttacatttaaaaaaaggccttgggtacatttcttaattaaccccacctctgtttctaaaggaaagaaagctgtaaaccaggagtaaattatattgccttgcaaactgtgaactgtaaacctgtaaactgatggtaaatgaattgtgaccagaacacaaccacaccccagccatgaatggatgtcacaacaactcaaagaaaatggaggaagaaaaatgtgtccataccatgcccaatctttcaacacttcatttctgaaggactgacagcaaaactgcctttctcatgcagctggttgggctgggatcttgtccaaatgcatgaaggtgactttgattctgtgttgttcagcttctacagagggagagaaggatacaggcaagagcatgctcctttgacatctcacaacggcacatggcccagctctgtctgactttggcactttgtccaagaaacttttcctttccaaacagcacatccttcttctgacctcacatctagaatcagttttgttccagagcataacaaggttctcgatgctcccatggctgccaactttgtaactaaagacaaatgggaaaagcaaatggatcctgggcaacatgtgccattactttcctggctgtagacagtgatgatgtaaggttttatgtggtctccttgccagcttctgagcctgatcacagtgatgaaactagcaaaggagtaattatgaacattcacataacagtgcagagagagcagagctcttaaagcaacagaaggagccccagctttatccaattttggttattacatacattttctgattctaatgcatttcatatattcatttattatgctcctactatagtgtatgcatatacatacagggaagtatatatagtctctgaggacatgatgttttacagaaaccttaatggagccattgtgaaaatttagggactggttatgagacaggggcaaggataaaggctctgagatgagagcactttagtgttttctgagaatagcatggagttcaatgtggcaagagcagaagggacaaaggagacagtggtaggaggtgaggttcaacaggaagccagaggttagttagagaattactatacctacttcttagaggaaaagccataggaatattctgagcagcggaggggcatggtttgacttttgtgctaaaaggggcactctagtggggagtggagaataaaccttgggaaggtgacagaagatgcaggcaggcaagtaagcacacctcataacatcacattgcaccccctaaatggatgtaattatcatttgccaattaaaaataaaacttataacaattaaaattcttttttaaaagagctaactgctgccatccagaagaaagagggagagagactggcttataccaaaaggtggaagtaggggttaatggtgagaagagttagcattcaagataaattttgagtggggagcctgaaggatttgctaatacacagggtataaagtgtgaaagaaaaagagaagttgatgatgacaaggttttggcttgaacagctgtattagttcgttttcctgctgctgataaagacatactagagactgggaagaaaaagaggtttaattggacttatagttccacatggctgggaaggctccagaatcatggcgggaggtgaaaggcacttcttacatagtggcggcaagagaaaacgagagaggtgcaaaagtggaaagccctgataaaatcatcagatttcatgagacttattcactaccagaagaacagtatgggggacagctttcggcctgttgctgggctttggtggaaactaaacatttgactgggtcatcaagtcacctgtgacctgaactgcctataatgaactgggtgctttctgacccatctagccataaagtgggtcatgcacagcagcattccttcatcaaatggaagtggtatatacattatcaggctcaagcaggtcctgaaggcacaagtaatttacacgaggaagtggctcaaatgcccacggtctccacttctgccaccttgccttctcttcccgagcccacacagatggcctcatggggagttccctattatcagttgacagaggaagagaagactagggcctggttcacaggtggttctgcacaatatgcaggcaccacccgaaagtggacagctgtagcactacagcctctttctaggacatccctgaaagacaacagtgaggggaaatcttcccagtgggtagaacttagagcagtgcacctgattgtacgctttgcatggaaggagaaatgaccagatgtgcaattatatactgattcgtgggctgtagccaatggtgaggctggatggtcagggtcttggaagaagcatgattggaaaattggtgacaaagaaatttggggaagaggtatgtggatgaacctctctgagtggccaaaaactgtgaagatatttgtaccccatgtgagtgctcaccaatgggtgacccagcagaggaggattttaataatcaagtggatagcatgacccattctgtggacacacctcagcctctttccccagccactcctgtcatcacccaatgggcccatgaacaaagtgaccatgctagcaggaatggaggttatgcatgggctcagcaacatggacttccactcaccaaggttggcctggctatggccactgctgagtgcccaatttgccagcagcagggatcaatactgagcccttgatatggcaccattcctcggggtgatcagccagctacctggtggcaggttgattatattggacctcttccatcatggaaagggaagaggtttgtcctcacaggaatagacacttactcaggatatgggtttgcctaacctgcactcaatgcttctgccaagactaccatccatggactcatggaatgcctattcactgtcatggtattccacacagcattgcctctgaccaaggcactcactttacagctaaagaagtgtggcagtgggctcatgctcatggagtttactgatcttaccatgttctccatcatcctgaagcagctggattaatagaacggcggaatggccttttgaagtcacaattaaaatgccaactaggtgacaatactttgcagggctggggcaaagttctccagaaggccatgtatgctctgaatcagtgtccaatatatggcactgtttctcccgtagctaggattcacaggtccatgaatcaagggatggaagtggaagtgggttacccccagtgatccactagcaaaatgtttgctttctgttcctgggacattacattctgctggcctagaggtcttagtttcagagggaggaacactgccgccaggaggcacaaaaacaattccattaacctggaagttaagattgccacctggacaatttgggctcttcctgtctttaagtcaacaggctaagaagggagttacactgttggctggggtgattgacccaaactatcaagatgaagtcagtctactactacataacagaggtaaggaagagtatgcatggaatacaggagacccattatggtgtctcttagtattaccatgccctgtgattaaggtcaatgggaaactacaacagtccaatccaggaaagactacaaatgacccagacctttcaggaatgaaggtttgggtctctccaccaggaaaaaacccatgacctgctgaggtgtttgctgaaggcaaagggaatacagaatgggtaatagaagaaggtcatcaataccagctatggccacgtaaccagctgcagaaacaaggactgtagttgttatgagtatttcctccttttgttaaaaacatgtttgtgcatgcgtacacttatattaagaaaatatcttcattttatttccttttcctttatcatgtgacataagatttattgacttcacatcagcatttaagtattgttaactttatgtaatagcgtttgggttggggattggtgcgcttctggttgtacgaaggagagttgtgttatgttaggcataattatgacctgattattgtctttacttgaagattatgtaagatctgaggagatgtgtatgagttcaagttgacaaggggtggacttgtgatgattaatactgggtgtcaagttgattggattgaaggatacaaagtattgatcctgggtatttctgtgagggtgttgccaaaggagattaacgtttgagtcagtggactgggaaggtcagacccaccctcactctgggtgggcacaatctaatcagctgccagcacggctagaatattagcaggcaaaaaaatgtaaaaagagaaactggcctgacttcccagcctacatctttctcctgtgctggatgcttcctgccctcaaacatcggactctaagttctccagttttggaatgtagactggctctccttgctcctcatcctgcagatggcctattatggaaccttgtgatcatgtgagacaatacttaataaactcccatatatatatatgtacatatatatagttatatatatacatatatagttagttatatatatatagttatatagttatatatatagttatatatacatatagtttttatatatatatatatatttctgtccctctagagaacctgactaatacaacaactgagtatattaaggtggggaacagggtgggaagggggtaattctggcttgaagtgggaaatcaagaactctctttcaacatgttaggttggagatgtctattaaccatcccagggaggcttcaactaggaagttaggtatataagtccagaattcagttatgactagagtcaaaaattcaataggtatcatgtgtttaaagtgatgaaacctagaaagttaatgcaggtagagaatagaaatcttggaaagatggactaatccctaggaaattttaataatttattagtgaagatgttattcaaccccaaataattaaacctatcttttagtgggtcattttttatggcataatagaaatttcaaaaggtgtaagacaaaggccttgccttcaaagaagagagattggtgtatttttaagaacactgccaatgaacactagacctagcctacctcctactagatgtgtgatctttaacaaattacccaatggttttggtttcaacatttttattgtataagtgacatactaagtacctatatcatagcaattttaagagaaaattaaattagataccaagtatatgatattgtagacattccagcttctttctcttcaaagaatgtttatttgggggaactgttcccccacacatcttccatctagtctagattgtaagctgcatgagggcagaaaacacttttatcttatatctgttatatagaaaataatgcctagcattgtaggttctcaacaattatctgtagaataaatcaagtgggaaaccagtaggtatatttgggtaggatttaggtgcctggatacttagatgattcaaagtaaatgctgtccctttacctcacagagtttacacacaacccaggcgtttcaatacaatgatagaaagaaaagacaaccatgatggaagacttaatccccaattaaaaacacagaacttattttccatcattatatttgtgtataatttaaatatgctgggttgcctttagttcatttaaagcaaagcaatgcatctaaatgaaacaaatatcttattcaagaagtattgtagaaatttattgaagttttctttaaaattcagtagttattcttgcgatacaaactatcgcaagagcaaaaaaccaaacaccgcatattctcactcataggtgggaattgaacaatgagatcacatggacacaggaaggggaacatcacactctggggactgttgtggggtggggggaggggggagggataacatcgggagatatacctaatgctagatgacgagttagtgggtgcaatgcaccagcatggcacatgtatacatatgtaactaacctgcacaatgtgcacatgtaccctaaaacttaaagtataataaaaaaaaagaaaaaaaaaattcagtagttatgtgtataccgtcaacaacatgcaatgaaagttctgaaagatctgctttacacatcagtggagcccaagtctcagagcccaaggcagtggctcatcatttactctcctccttgcactcttctcaagcctgaagctctcctctctggaaagatgacatcctggcatctccatatcttttgtttgttaaaatgcatattgatatattgattttgtttccctcagtttccttgagtgccctcccctcatatcaccacttccccactccaaccccattcctcattatgactggggctttccttcttaggagtcggagtaggagagggcagggggattccagtggcttgggattttttttttaatatagttcttatatgttaaaaaattgattatagcaagaaactcacactttagggtctgaatggaacctaggacagggtgatgatctctaaggagaatttagcagggcagagggtgtaggaatggccttctcttgctgactagccttctctctcactgtcttctcatgtttgtcctcatttcctcacctgtattcgttttccagagctggtgtaacaagataccacagattgtgtgacttcaacaacaaaaatgtatttcctcacaattctagggcgaggtgtttgagatcaatatgtcaccagggttggtttcttctgaggcctccctcctaagttgcaaggagctgtcttctcactgtcctcacatggtctcttatctgcactagcatctttggtgtctctttgtgttcaaatttttcttcctataaagacacaagtcagattggattaggtcccacccatatggccttatttaaccttaattatgtcttttaagaccctgtctccagaaacaatcaccctctgaagtattgtgggttaggacttcaacatataaatttgggaaggagcacaattaggctcagaacacctatgtaggagactttttccacaactgtctctcttgcttttccatcttgggacgatttgagaggcctcaagagcaccgtgagtaaagtgcagaatttgaactagtcagtccatagtatgactaccaattgggcactgtggtggaaagagcatggcctctgccctagactgctctgggactgactctcaactgagctgcttactagttgagtgaaggacaaaataggcaagtcacttaatttctctaatggaaaatttccatatatttaagttgaaggcatcttctttcatagacatgttatgagtattaaataaaatattttatatataatagacataatagatatataatatctattatatctaatatgtatatatatatgtgtattacattcctggaacccagtggatattaaataaatgttactgtcttgccttccatttcttattttaaatggcagcctcttgtgagaataataagatagtaataagttcataggctagtattggaaatattattaggtatatataattagtgctcaataaatggcagcttttatcattttaagtctctctctgccagtgggacacatttcccagagtgtccaagccaaaagattttttaagggaagttaggcctttctagatacaaagagtatgaacagggctgagtatggtattgaataaaccagcttgttgcagtaaacagccagtacatattgatgcattactgagatattgttaatctgtttaaattctaaagcagtttaaaaatttttcataaatagccatagttgttttatgaggtatgttgggcttgtaaattgctattttattgttattttgaggaaacagaagcacaaaatacaaaaatgtaaagtcttacggcttgatggtacagagcttattgccctctactttctctttaggactcctaaagtaataatattggtaacaattacgactgtaacaacaaaaataatcagattatgtaactctttagtaataacaaagttttcccatctatgaattgatctgatggtcacaaaaaaccactgaggttaatcctggcagggattattaattaaactgagcttgcagatgaggaaaaccaaacttaaagagtctaaatggcctctccaaggtgagatagttaatacatgtgcatagttgtagtccactctaaataagattgttgaataaatacaggagtggacaagtcacataaaacataagtctttactcagttttattatttccccttatgctacagaaactgcaacttcctgtggaaaccactggagaagacaaaccatagctgactattgaggcagggaccattctccttcaacttccaacttcgccttcaattattttaacaaatcaatttgtaggtcagcttaccttagaagcatccttaagcatttgacatatttttgtaccacctatacttgacagcacatgtatattttatttcacttgaaattaataaagcgtggaaaaaagcacacactctgatgtcatttattattgggaataaaactggctctaccacttattagctcttattaggcctcaagtttcccaactgtaaagtaagagaacaatagtctctaccttattgggcaactgtgagagttaaatgagatcgtccccgtgggaaacttagtaaattcttctgaataatgtgcactattagtaggaattatgtaatttttaatataagcaaaaggcagagaagaaaactgtgataaatgcccctgtggaaagaggcttggtacatgccaagcccttcacaatgtgaataatgatgatgatagtgacagtggggattactgtggagaggatgatgaggatggtaatgatgatttgtgcctgtgataggcatggtcagggctttgaaaaaagccttaactatacttcttatcaactgtaagctgtggaatatatccttcttatttacaacaaatgaatgaatgaatggagaaaaaagagcttctaactctcctagcacctatttctgaaacaattctttcttacgcctagacatcaggaatctctatttctttcaagagactgaaaaaatgtcttctgttgaattggtaaaatctcaaaaccaagcagccaggaatttttttttgagaagttcctaagaagaaaataggtcagcataatctaaagcaatattttcaagctgacaaattggtctctttacattctttggctgtacttaatgtcaaatttaagaatagtgttcaaatgaaggcggtaacaatcagcccatgtcaactttggggcttggctaggttctgtgtcatatttaaagagtgacattggcccagcaagaaaacctcagacattgattgaccagaataggaaaggactggaaaccagaatccataaagaatggtgagagaaattgaaatgtttcccctgttaataaaagggaggggttaaaaaaaagtaactatctctttttacatttttagaagagtgtcacatggaggaagaaggaaactgaatctctgtgtctccagaaggcagttctaggaccagtgcatgggaatttcagggaacagatatgggttcatgttaaggaaaatcttgctaagtgagctgctcaatgctgcttttaaaggtaggaagagggctatgttttatattcaatatgctcttcatatttttttgccttttccagctggtttatctaaacagttataattcatgttataatcagagaagaaaaccaatacatgctataacataaaggaagataaaactaacatttattgaagagatattatttgcccagtgtttgacatacattactggataaaaccagtaataaagttggttggggtatacacacgaaattttttttttctaaccgctaccaccagatatgtcatagtaagtctttttattatcatattgtattaacttctgaagtgagtgctatgactttataactattttaaattattaaaaattcagtctggtacagagttaacccccaaactgattagtcaccctcttccttctcccagttcaaatttgacccatggctccagggaattgcaggtgtgtgtatgtggggtgttgtccttcttcctctccttcttgttctacctcctcaggcggaaaggcttatgggaaatgaggaaaaacatttacatttaactgggtctgcagttgtatcttctcctggatgtttctactcctcctcaggctaacacaaattattctgtgtggcaggtttccacacaaaggtgcttttgtaggggtcatgtatgagttcttgcacagtttcataattggaatattccattcctactcaatttttcccccacaaaatatacatacagcaataccataagcaatatgcttcagcctcttgcagtcctggtccccatgcctgtgtggagttgttctcttgggtgacactggcaaggtaattcaacccaagtcacctttcctgggggctctttattcacaggaaactaacttattcttaccacatcaagtggtggacataaacctgttggaaatttccactttttactccaccttctccttataactctcttttatcttgttcaaagagacagtgggcaaataaagaatcttctgcattaacagttgtctcactagggaatgagatgcaagtctctccttcttgaaggtgctcccattctttagcattgattctcctggggcctctcatttcctctgggatgaggaggaaaaatgagcagccctccccacactaggtcaactcatcatgactcatcatatttgcttttccactttatcattttccttcttatattctgggggtgtgggtggtggtagctagttgaccatcagtggtagtagaattgtttgcctacttcttcctcagcctaagagacactcgcttgtgggtagccctttggtttctcttgctctataatgttggaaatgtaatgcatatttacttctgtttgatggcctactctccagtctgcggacaacaagaaaaatcccatttactatccatggtacatacatggtcccatttaatcctcatgaaaaaattatgaagaaatactgttaccattttattgacaaggatattgagactacaaagggctaagaaagtacctaatgccactgacactaagggaaaaagcaagaggtgaacccaggcttggctgacttcaaaggttattctttattcattataccagaagtggccacctatgtagcagagtttaaaaacatgaccttggctaaaagcccagtttttaccagggcaagtcatcttcttagagacttaggtctctcttcttcaaaatgggtgatcagtatggtatctaccctcagaggtccttgggaggattaaatatgataataaaactcaagtgcttagcttgaagcctacactttataagtgctcaattaatgttactgattgtgtcatgcaaaggggtcctacatacatactccctttgtataaaactaaaataggatttatacagaataaaacttacaagtggaaaggaagcacacacagaccttgggttcttattccatagagagttgactcaggcagacagctctattggggacaccacaaaacgtattccaatagataagaaccctgaccccataaaactgtttctgtacaaagagagtaggaagaggggtcctctcaatgacttcctgcttataaagtgaggactctccaagtttaacctctggtatcagactgttttggtagagctcaggaatgttgagatggctcttgcaaagctagagaataaggaaatgagcttctacagccatcttagatttgtgtttccttggggattattgctattgttgcagttctgtttaaaatagtagtgatccatgtggcaatggcaataacaataaacacaaagtattatactcagagctactcacagataatgagctccctgcccctggaaaaggtccatctcaaggctagatggccatctttcagccatctgagaaaggattccagcactgggttaaaggttgaagagatgacctgtaggtttcaattcaaatttgaatttctctcagtctatgagtgacttgaattggttacatggatccaagccttccttcttggcttaaactactctatgctatttccattttgaaccagcaaagtacccctacccacaagagtctctagcccacctgcaccactgaatggtaatgttgacaaagaagaaaaccccagctcattctttgagccaaacataccacattggtttttctcttccccgaatatgcagaccgtttatttagagagcccaatgacttagatctggttatatattattcctagtggatatgtttgctcacatccatgggacttcactgttgaagaactgtgagattattgcctacatttttccaaatcatatttaatatagctgcaagccagggtttcggtagtgtggcataatctcatcagaatgatcaattccttctgttccagaaccaacgggcattcaaccttgccttagagaaatgctagctggaagcctttggattctcatatcactatttgttaccaaaaaaaagaaaaaataaacactgctagcccagactcatacagccttcatttccttggaagtacaaagacttttcaagttggtttagcataaacttctggatgaaccactgcatctgtgaaagttaatgtcctgtactttagcccagatgaataaatccatctccttattggcaccatgaagactttccatttttttgaacatttaaagttccttttttatgtattgggagaatttttcagccaagactgcctgatttttgaaacagagtttttgggtgttcacagttaaatggaaaagacaaaaagaaaaatttaaaataatcaagagaaacaacaaaaaaaaaaaggaaagaaagaaagagaaagccaatcaaccacaataaagaacatttaaatttatttctttatggactaaatttcctcaaatatagacaaagccaagaagttggaagcttggtttatttttttatttttaaaatattactttctttcaatttatttttatattggtagatgatgtgagactcattacattttataggcctgaacaaaatcttacaatttcttactaatattatgcaatgacataatgccatttgtagaggtgtcacataaagcaattgacttttactggcttcttatggcagggcttgccattttatattctgttttatgtaagcgttttccaaatttatcgacctcacaggatttctcaagttgcttaattatggtaggaagaagatatctctgtggtctgacacaagaggctattaaagtctcctttaaaaagggaatccgagaagtggggaggtaaatgtggctaacatttaatgcatgcctactatgggctggatgctgggaggtagggataaaagtacctggcactgccctgaaaataccatgcaacatatatttatttttctaatttcacagatgagcaaactgagtctcagttgctatgtccagcatcacagtaggtactaagtaaatggaggcaccaagatatccactcaggtttgacttcaagtccatgctatagaatcacaaaggacagcaatgctcatatcatgatggatcagcctctcagaggaaaactctgaaagcaggtaaattctttacccagtggatgaaggctcaggaggacctccccagtggattaagaaatggagtctgtctttttctttttacctagtgttgcagccttcacatctggatcaagcaccatttctctctctctctcttttttaatacagggtctggctctatagcccatgctggagtgcagtggtgagatcttggctcactgcaacctctacctcccaggctcaagacatcttcccacttcaacctcccccgtagctgggactacaggcatgtgccaccacacctggctaatttttgtatttttagtagagacagggtctcactttgctccccaggctgttctcaaactcctgagctcaagagatcccccgacctcggcctcccaaaatgctgggattacagctgtgagtcaccacgcctggccccaaccagtaattcttaggtaagagagagaggtgcaccagggatgctggtaggaaaaggaattcaagtcctactaataatacaatattaatgctctcacagatctaagagagctcctaatcaacattttattttcattttgggggtatttgaggccctaaaagggaaaatgaagagctatttgaagtcttggccaataacttcaatgatccattctcttcaatcagaaccagtgcttggccactagagaaaaagtacatacagttacaaattgatggtcaagttgccaactgccatttattgggaagtatcaatatggtacttctgtctctgagctcaccatactggctactggcaccattgagctcatgagtcaagttatggttctacctgactagttatttcactgttttctgaacattttcctcatccttcgctctctcacggaataattttccttgcttccagtctaaaatgaagcaaaaattaagcctcaaagaaactgtttacctctgtgagacagtgtagtgaattcttataattttaagttgcctcagcatccattttgaatacaagtttaagtttctcataccaagagcagcaatcaattgcccttgacacagtttcaagttccacatgacacacaaatggctcaagctagtggccagagataaaacttagaggcatccctccttcctagcaggctagacccctcgctttctgcacctcctgtaaatagacttttaggcatttgcctgcatacttaaagtgacccacaccctatttccttatatatactgctagttgtcatgtgttgtctctttctcttcctgaattttcatttctacctcccatgacccatgacctggggccagaagactgccctgcgaactcattgagcactccctgcccagaatctgtaagtaaaaatctttgaggttgtttcctattggtggtggtggtacattgaatttgtgtcttccacctgaagaactaggaattgtcctaggctagattttccccaagatattggggagaacacaagatcaggcccccagcaccacagcgatgcttaggcaggcataaactggccacaggtcagacaagagcacaagggcatctgccaacataaacaagtttcctgcatgagagacccctggatcacaggttggacaactaggtattaggccacccaccaggcaaaggaagtatcctgtgaaaggaatgctgtgaatacccatgtgcagccaccctttatttcccattaaggtagggttgctagccgctctggtactaaaacctcagtttagttggggcctctcaaaacagagaggaagattctaaaattctcagatgcatacttgtcacaatataatctcagagtccttgagattagataattctgagattgggggaaggaaaaagagaagatggaaaagtgattttgataagagaaggtaggagggactggataggattcctttaactgggaagcagaaaaagcaactttcatcaggggccagggagcaaatggtagaaacacagaacaagctacaacacagaacaaacacagaacaaccttgagtgtggacaccacatcagatgaataacctgcccattgacattactaggcatggttagcaccagtcaacatgaattgatgggacagagacagggatgtttgtcaccttgatggagaaagtgtcatgatggaaaaacctggcaatgtgggagcaaacaactgattgcaattcccctgagagtggtgcgggaatgacataccaacaccatcccatgtaatacgggctgctttctttttctccttcttttctattgtgaatgggagagcagtgtcatcccctgtgtatctccagccatccattagagcttctcatgtatagcaggcacttgaaataatttgttcaatgacaaagccaatatatgaagtaatttgtccaaattaacacagtgagtttaataatctgactaggaccaaaagccagggcctcaattgaagtccagtagttcttccaaatgttttctgtcttaacatacgcacagaaggatggatgaataaaacagataaaggacagaactctgatgggaggaggggttacacagagcacagttttaaatgcacgtttttattctgagttctgattctgcccaagtaacaatgccgttcctctcagtcagtaactgtggcttccaggaagtataactgcttgagcacaggacattattattcaatttacatcgaccaagcagagactgcctgatgacattgtagatagacggtatttgtggctttgagactaatgatttgagtttttctcctagtttaggtttgtgtccttacgagcatgtcagagctgtggtcaaatctaagtagctccaatatcagagagtagaagtaagttttccttgagtattacaacaatgccagccggccgctgtgttcaattcccaaaaatgaaagaaatattggagaccatctagtctagtggttttcagctgaaggtgattgttctcttccagaagccacttggcaatctctggcgacatttttgattgataattagcttgtcttagtgtggactggtacaacaaattaccatagactggatggtttaaacaataaaaatgtatttctcatagttctggaggctggaaaatccaagatcaggcttccagcattgttgggttctcgggaggccttcttcctggtttgccgattgccatcttcttgctgtgtcttcacaaggcagagagcagagagagaggaagcaaggcactaatctcattatgagagttccaccctcatgacctaatcatctcccaaaagcctcatctccaaacaccatcacattagggattagggttcaacatatgaatttagggggaacacaggctttcagtctatagcgcagaggatgctcctggcatgtagtgagtagtggccagggctgctgctaagtatccccccatacacagaacatcctcctgctataaagaattatctgtcccaaaatgtcaacagtattgcagtcaaaaagaacttctaattcagttcatatttttcccaaagtagaattcgtctacagtgaccttgatatggaattttccagcttctggttgaatatgtccagagatttagtactagctcactctttcactactgaatgctagcttagttgcttgtttttggtgccccagaatgctgaatgcatattatcacattgtttcataattacatgatttttgtgtctcatctattacaggatgagctccttgaaaagctaatcatatttcatactcatctttgcattatcggcttctgcataatgcttggtactgaaaatatcacttaataactattcggtgaataaacaaatgaaagatgagaagtctttcattttaagttacatcctatctttagactggaaatctcatgcttatgttctacccattgaaagttttctcttggactggagatggaagagacagaccacttgttgcaccactctatcttgccctttgcctcaaggctgtccttgtgagtttgggaactatacatattcttagtttgaacttttctctcattggaagtaaaactttccataaaagtgccaaaactgggggcaaatggaaagcattttatcatcaacaagtttaatttgctgagtgctttgcattaaaatcactgaagtgagttgggctggccaattcccaaactctattgccaaaccgagaggcactttctcatccttcctttaaatggcaatgagccattggatcgctgaacttggacctatattggaaggaagaatagagtatgaaaaccaattttcccatggggttgaaaaggccagagtgacttaccatacttttccaactctagtttaaagtctgtaaataataatgtaactcacatttgtaaagagcttatataagccttagacatctgtcctatcttttttaaagaaaatatgggagcaaacaatttcttctattaaaacactaatatattgtggcacagaatgcaacactggcgtgatattttaagatagaattatcttcaaagaaactctgcattcgtgacggagtgcttagagctatatttccggaccattctctcacttatgtttgtaagtgaagttaatggaaaatttgacatgatctagcacacattttctcttttaatttcacagttcatctttttcctctttctggaattttcttttaccctctctcattcattcttcaaacacactcttattctctaaagctcaactcaaatatcactttctctttgaagatttgtttgattccccaagcactggctcccttttccaggtttcacctgcttatattcaaccacttctcaaactatgttgtaataggctgcttaaatatccttctttcctgatagacagggatctcctaaaggaaggggatcatattttatcttctacttcttttatggcatcctttctatagaaacaacctgcaagaacttaaccttataatttggccatagtgagaaacttctttctcaatattcccaagacactctgatcatatttatttctgatttgtttctttcgattaattaatttttacttgatcaatatacatttactgaggttctagtgttaattaggccctgtggatggttatacaaataataaaggactgaaatatatgaagcacctcccctgtgccaaacaccatgctagcatttaataaatatcttcttatttaattcctaccacaccatgagaggtactattgttactagtttgcagataaggaaactaatgtctatgtatttaagtcacttgttcagggtcacacagatgatatttatattttatggaagttttaatttaactgagacaatataacatgcacacacatgacacacaaacacaagtacttttttgggaaagagttattttttatgtgccgaagctgaagcgtagtaaaatgaacagaagttttgggttgtgtatcatggtctgtaacccaatagcgcatgactaaataccggatacaatatggttttctttctacatccattctccatcagaatactcccatccctgtgcctcctcatgggttctgtgaggctgatctccaagtactgcatctctcaggctgtcctgctatctgttttctgttgggtttggggaataggaagcatcagagaaaggtaaagaattcaaggtattccttcaccttcccctaacttcttacaaactactgggccaggccttaaagagctctcttctcttgggagctgggtgggagagtgtggctctcttataagcataacttttaccaagttcttataatagcttcctccccttgtcctttcaggcatgagggtgttaatacttcttagatagaaactttcaggagcagagtaccttcattcaactgtcttcacatagcccactgagtgtgccatctacgttgagacagagactgacacacctttgtctgagcctcaatagtcccatctgttaaatgggtatagtaacatgtaattcagagaaattttgcgaagataaataatatatgttaaaagtacttcgaaaacttaaaagtaccaacatttgtaatcataaacttatttttcagttctatagaattcatactttcatttatcaaatatctactgaggaccaattatgagtaagaccctatgctaaatgctgaggaactctgttgagcagagatttaattagaggggaagagactcctttagggtaagtgagggaggagagaactcaataaaaataaagagatgaccaggtccttaaagaatagtatattttataggtgaagttggggaaggggggataaggcatactaggggaagggaaatgtgtgtgggaatgtttagaggtaggggagagaaaggcatatttgtcatgagtgagtaaaccattttcatgggggataaggctgggaatgcagtgattttcaaggtctttgtaaagagtaattgcatcctctaggatgaataagaggaaaatgaattccaatatatcttaatatctttttcctactgtgggatttgccctgtgaaaagctctgcattgaaaaataagtgatccagtgggatttggatgtctttacagcatgattcgattgattgtactaatggattttgcagcagattggatattaaaatggtcaagaaaggatttgattgaaaatcactaatttcgaccaactgatacctttgtcaacaaacattcattgaacttctactatgtaatatgctcttgggccccaaggaggttaaaaagcaaacaaacaaataaacaaaacccaaaactaaagaaaaaaccaaccattcatcgaagttcatcgacatgggatcctccacatgcccttgcttctgccattccctgacatgtgcttttagaatcaagcacagggcatgaaacatatttggtagatacacaatagaagtatatgtacacaatagaaatgtatttggtttatacacaatagaagtacataatttttcccttttaatctaatacataaatgaatgcctcacttaagatataatctagagcagagctacccgatagaacttctctgtgataaaaaaaaaaaatgttccactttggtgctgtccaacaagggagtaactggctacacagggctattgagaacttgaaacaatgcaattgaggactgaattttaaattctactgaatatttaatacaaatttaaatttaaacagccgcattttattagtggctgctgtactgaacagtacaagtctagagagaagtgttttataaatagcaaataaaactctttctccctgtcttcataacactccacagttgctgaagctcttttccaaccagtctaattgctatgtttgagctataatgtggactgaggttctaggaaatctccaatcactcctatcctgttgttccacgtttaaagttctgtttaatccatctttacttatctctgtcctgaaatggtgaaatgggggtagcagaagatgatttcccaattgtaatcattgtgatttcttgcatgtatttacacctgctgctattaaaataccactgccttatttagtagcccctgtagtcattctaactaatcacaaaaaggcttggttagcctttaagtatgctcagacatagttgctgggtgactaggcaaatgaacaaaaagttcagaagttcaaaacaaaaagttcaaagccttttcaaagtaagcatcataacattatgcaacctcaaactgcccaccattgacacatctcagggtcagaacctatattgcactgaagcaagcctcaaaaaatctaaggaaaagatattatgtatctagtttttctagtcttattaaactattttgtggttctctgcatattccacatttttccatgtgactacttctgtgcaaattctgtttctctaggcagggatacccctcatctccttggttgactgacagacttcagttcgggttgtgcttcaagaaccagcacaaatggcacctcctttattcagttatttacctgaactcccacaatagagtgaaatttgcacataccttaatcagaacaaatggatttctgtagatattccttggatttgttatggatttatgcttgtgcatcatgagcctattgaaggtaggggctgtgttctgttaatcttttttttcccaatacttatcaaagagctaaataatgattcattcaaagttcatggacagaatagattgcaagttagttgttgtttctatgtatttatacagtaatgagtgattgaagtaatccagaagagatagtccccaaatgtttgggtcatacactagaatatattatatgatttaaaaaattttgccttttaaaatgtattttgttggggataatattaaaatttcttcattggtaagtaataatacctcgagtctcaaagctttgagctccaactaatttgattaaccagaaatacagctttattacttacccttctacaactacctgccgtagattcttacattcaattattctggctgagtattgcagaggagacacgattttcttatttatttatttatttatttatttatttatttatttattttattattattatactttaagttttagggtacatgtgcacaatgtgcaggttagttacatatgtatacatgtgacatgctggtgtgctgcacccattaactcgtcatttagaattaggtatatctcctaaagctatccctccccgctcctcccaccccacaacagtccccagagtgtgatgttctccttcctgtgtccatgtgttctcattgttcaattcccacctatgagtgagaacattcagtgtttggttttttgttcttgtgatagtttactgagaatgatgatttccagtttcatccatgtccctacaaaggacatgaactcatcattttttatggctgcatagtattccagggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgggtcaaatggtatttctagttctagatccctgaggaattgccacactgacttccacaagggttgaactagtttacagtcccaccaacagtgtaaaagtgttcctatttctccacatcctctccagcatctgttgtttcctgactttttaatgattgccattctaactggtgtgagatgatatttcattgtggttttgatttgcatttctctgatggccagtgatggtgagcattttttcatgtgttttttggctgcataaatgtcttcttttgagaagtgtctgttcatgtccttcgcccactttcccacaattgtccatataaaaaatctactactaaaatgtaaattccataagaacagatattctcttttttgagttttgattgctgacaaaaatccatgatctagaacagtactttgtaccttttaatcactcaatacatagcttgtattaaaattaattaataaatataaccaaagttttctgtatctttacaacttttcattccaccatcctctacagtcaccataccctttttggaatggagagccaactcttccattatcatgctgccactcacaaattgctgcctatgtcttggcctgggcccttcctgacctcctctagacaacggcaccccatctctctcaggcaagtgttcatcctcttcttacttctcccctgcatctacctctgggattccttcaccgggtcaactctttccatttgacaaggccagttcttccagtgggggcttctaaaatagagctgatgtgccctagtgacactgttttcctcttcaaatgagtcttcttcccagaatacacaggtgactcaagttaatgctggtaagggatgctctagatgtgagcatgctcgaacagaatctgctagtgtaagtgaaaccacagctgtctccaacagtcagtttccttctgccaggctacttctcttagtgtgatttttctctcaggaaacttaatttattctccatcagttcagctgtcttcacaaagctccagtttagtgtacagctatgggtctggatttaagctgtctttcatgaggctccagggccacatgcaaatcaaaacatgtgttcggatatctgtttgtgttctttccaagtttggccttctcaaagaattcaggttatcccaagtgtggctcatggagtaaaagcatgcagggaggtgaaattgaaagcctttgtaggtgcttagtaagaaaacccattatgtgggctgagttcagaattggagcggcatgggacccattacattccccattatagtttgtcatgaaccaaagtccagaaattagaagacaagtttactggatagaagctttctacaatagtgcccagaaatttgctgggctattagagtcacttaggagtcttcaaaatacaagcacatttctgggacataccaggatctcttcatagttatggagctttataggtatctccccatcccctgtgctttgggagcctggtcacagaatgcctctagggtggtgcctcttaactcatacatatggaacacatagaaattaataatgcttaatgtttacatagcacactggaatgaaggaacacagtaggctgccctgaagcaaccacccaaggggccttcagccactccagaatcaatatggcttcccagcttgctgagaggattactcataaatgacactgcataggcccactagggaaactttggtttaaggaaagtgtgacctaactgaaccccccagctactaaatatcagatctgaataaagccacattagcttcttagatctgtattccctgaatatttccttaaagagaatggaagacagttggaaaatagtggatggaaggtcactccaaagtaaagtgttttccatggatacatccgcaaaaagataatttgcatgaagataaatatataattggaacttatatgataataccttattttaataagtgttgctcaaaaacttcaagttcgaactccttaccttggtattcaaagttctccatgttggtgactatttttctaaatgtatctctttcttttcctttttaaataccctaaattccagctaaaagagctttcatgtatttaccaatggaattttggtagttttcaacaaatgttttgttttatgctcaaacttatttcactcctacattgctcatccttcaaatttcattgttctcattgagaattttctgatttctccagccagaaatcatctttctgtcttttgaactattacaatctcttttctgggcctctattctacttcgcacatactatgttgtattatagctatttgcacatgatctggtcagtcagaatcaaacaggcttaggtttaaatttagtattttccactttttagatggatgaccttgtaaatttcctgagctgtaatttcttacgcctacatatgttaagtataaaaatatctaccctgctgtaaaccattggcaaaaaggcctcaattttcaaacctgtatctttgctctttgcactgtgactttgtagctcattcatcaataggcagagtctgtttccctactccctgagtttaaactgttcttgagatttgctttagccaacagaatatgacagatgtgaaaggttccagttctgaacataggcccctagagtcaagagaccttgtggactcccatttgctctcctagaatcatgttcaactgtcatgtgaacaagccaaggctaccttcctaaagcatgagagaccacatggagcagagatgagctgtctcaattgagaatattgtagatcagccagatcccagctaattcaccagcagatgtatgagggaacatagctgaaatgagaagaatcatccactatatatatgtatgtatgaatatacatatatatgtatgtatgatatacatatatatgtatgtatgaatatacatatatatgtatgtatgatatacatatatatgtatgtatgaatatacatatgtatgtatgatatacatatatatgtatgtatgaatatacatatgtatgtatgatatacatatatatgtatgtatgatatacatatatatgtatgtatgaatatacatatatatgtatgtatgaatatacgtgtatgtatgaatatacgtgtatgtatgaatatacgtgtatgtatgaatatacatgtatgtatgtatgaatatacatgtatgtatgtatgaatatacatatatatgtatgtatattcttatgcaagctaaagtttgggaaccaccaactaaaacaaccatatgcatgtatgtatgtatgtatgtatgtatgtatatacatatacctacatgcatgcatacaaagtccaatatatatattggacttacgaagtatgcaaacttgcatgcatactacaaagtccaatatatatattggactttcagtcctctgtgtgtatacacacacacgtgcgcgcgcgcgcatgcgcacgcacgcgtctgtaaacacatacatacatatggcttttttaagttggtggtttccaaactttagcttgcatcagaatcacttcgggtgtttgttacaatagaccaatgagctcccagagtttctgatttaaaggtctcgcatggaagttcctaaatttgcgcttccagtaaattcccacgtgatgctgatgcaggtggtccgggtaccacattttgagaatgactgttttaagctgctagattttgaagtagtttgttaatatagcaaaagataccgataaatagggatatcgtgaagtttagtaattacaaatttaaatttgtaatttagtagacactcaataaatcttattattgttatctgttttatctcctcaagtagcctataagttcctcatggaaaggactattacacagctgagtgcatcctactcttattatcaatttgccgtaccttgcgtgttgcaaacatatctttcagtccattatattccataaatagcaagcaggtgtcatatgcaatcgctgtgctctttatcactattatgtcctcactcataatttggagacatttcctaaagataatttaacactatttgatcaattgtaaaattcgttcttgcatctatgtgtttatgaacttcttttaaaaagaagtcacagagggttaacgttttataaagtggtggctgaagatgtgtagtgctacagtagcttaaggagttgaggattctggcaaggaagtagccaaataatcacccaggaaaagaaagagaactaaggggagaattaatagactggaaagaaatggaaagattaataaattggcgttctctataaggtctaaagacaactgtagtgtttataaagtgtaagaaaagataaaaggagtgaggtattgtcaaaatgtaaactgagaatttaagactttgagggtgaacttattgaatgatgcctgggaatatgtgtttttaaaagatcaaatgattctgctatgcaacaagtttggtaatgaatattctacaatattatgctctttactgtcatcaaaattcatgaagacaaagcagatgatatctacttctgcaagggctgaagaactgatgccgagaactttacccgttacatcattcaacgtttcttacaaaatctcatgtaaaaagcttctttccaatgtagtgacagaaaaaaaagacacattggtctttcctgaaggattgctatatttttttctttatgatgttgaagtttataaaattcaccattgttacctcttcctcctggctgccaagaagccaagaactaagcccgaagcttagccatttctagattgtgttaagtactcttaaagccccttgtgaatacctctatatgaccatttacacattatatttaagttattcatttaatatatttttcgtcattttactgtaagctcctaaaagcagaaactgtatcttttacgtcagttcatctatagtaactagcctggtgccttgtatgctgtaggttttaggaaaatttttgctaaattataaaccaaatggtggtaattataaagctaatggtcactagtttttctgttcccttctttcatgtgttttaattttatattttcacttattgatcttattgtacatgattcactgttacgtattaggagaaaattcttttctctccattccttctattttctttcaggtggagatagccctgttagtcttatacttctggcttctttctgtcagtttactcaatatatcctaagggagggtgagcgacttatttgattggtaaatctggggagaataaaccagacatgctcagcccaaatcctccatttttctattttcaccttttaggtcagttagctctgggtttctttgatgaattcctttttattcatctattcacacagatctagtttggcctcagaaacctcaactccctttgtaaatacatgtctcactttttcatttcccagtattttagtttatccactgttatttccagaacaagaagatgtttgctgaatcccccattttctcttcacctacaaaatgtccttcaattacctaatctgctgctatagctcttgcactgtttttgagccagactatttcccaataataaaacatcacaaatatgcttcttctatgaattttttgttttggatttgtggtaatttttcctgctttctccatacaagcagaacttgcatctctaaattgatagtagcctacattccttctaaattgctcattaatttatcgttggaataaataaaatatattttatttcaaaggatgaagccacactggatctccaatattcataagcataattggcagttgttacaatgtagagcctcaaagataatgtaaaattagacaagacatgcaactctagactagccttggcttggttccaagtgagggtcaatatttattatctgaaggcctaaaatatctcagaatggtatacaaacctagtttacaagcatgttacatggtatgaaactaatcattcttccaatgtttgaatgtagtgtgcaaaagacctattaaataaaaggcagcatgaaaaataaatgaaaatagtccgaatcaaagatttcatgatcccagactcaacacaatggtcttttgggagtcgtttaaacagtattttcctttatattaatagctcaacttcttaaacaattagtcagcagataggggccaaaacatattgcctcccttctttactttgataagactaagttagagaatgtagtttatacatgggaagtaaacctccaatattgatccagattacatagattaacccagctagttacagtcatagccaaaagtctacaagtcttctctaatgggactgtctctcattaaaatatggcatatcagagcaggggagaatgtatgccttctggaagttatgtgccccacgaagaaaaatggaggagctgcactgagcatgactagttcatgcttccaaatttacctattataaatgcatatgtgtcattctattttctctgcactggagtttgtagagagagagagttcaaaagcattagaggaactgagtccacgttactgaggtcagtcaataagcttcatacaataaatttgaatgaataaaaggaagaacaagataattgagaagatctcactggaaaaatgtatattcagatagaaaaatcgttgtagaattgctaggtatcacccttaaaatagtgttttaagcaccaaaatttttaaaaagtattatctttaggggttgtggctaaatttacttttcaacacctctactaagctctaggcctgcctgagagtagctgaacagtagcagtatggtcaatatgcacccacaccaagcagtgctcacatgattataaatttagaattgtgcaatgaagtaccacggtattacaagaataatgacaataggggctcacatttaagagcccccttcctgtgtgccacaaatgtgctaactgattacatattaccatgtttgatcttcaaaataattctatgagttagatatcaatattcctatctataatcagggaaaacaacgctaagcaacataccacagctcataaagctgaaagcagcaaagtcagtatttgaccccagattgactgactatgaaccctgtgttcttttgcatatgccaaagtaaacacatctgtaaatattatgggactggattacgagaactctaggaccttctgactttctatgtttctgtggcccgacagtgtgaaaagctcctgctagttaaacgctaccccagatcatcgtttttcttctttcctcttttcattcttttctgtttctcttctgtttgagagttccagtgggctaattggaaagatcttgcataaatacagtaaaagtcattatgaggttatccaaaggacaaaatggggagggaaggtatggtacaagtggaaaattgttgtaagtttgaattacaacgtggttggatctgctcagggcttagcagaggaagacattatattgctaggacattgctaggttttactttaagtttactttaaattctaagatacaaagaaggctttaacttaaaaatggaagataaatatttcacaaatatgttcttatatctcataatttgaaagattaatctctgaagaaactatggagaatactgatcatcatcatcgtaagaaatattcctggcaattcttaaaacacagttgtattcccccagtttaagtagtattatgctggaaagaggagctggactttcaacgtaaatatttgtattttactgtgtaaaataggatatattggttggtctctctgagcatcaacttcttcatctattcaaaagtccaaaatcaaatccattttacaaatattgtgagtgagcaagaaataataatgcagatttaagtgcctagctcaaggatggacctctagcagatattaacaaccgatggattatatttaaatcaatagagatatattattacattttcttcaaaatcccagataactttcttgacaattgtcataaccttgtaaaaggcttaagatgatttctatttattcaattatgcatttaccaactgttttagggtgcctacagtttgccaggtgctgtgttaggctctacagaggtagaaattaaaggaatgttttcagtttgcttatgatcaagtagggaagagacaagaaaatagataattacaaacatcatcatgaaacattgtagggtagatgaaatgtcccataaatgactcctaactgtaaaataaaaataatcctatatctaaccagattggtccatggagttctttcgcaactcgttaactttctacttctcaacaaatcactttgctctgatatgtggctctgattcttataaattgaagatatttgtagtattgaaatgcacactggacttgggaacaaaataactaaatttcagatctgggtttgtcatttagccattgcctgattgggcaagtcaagatacatatatgaatgttagttctcccctctgtgtatgtgtttatccctgtgtgtatacgaattaaacaacagaatttttcatttttatgtaacattgcaaaataatcaaatggtttagcaattgtaaaaagagcaagaaaaatctagatttttccacacatagcaactaaactaaatgatcactgaaagtcacaagttgaatatatgcagcattatttaatgccaaatgagggcctgcctctgcctcctgcatccagtgaggtttcaggaagggagggctaatacgaggtatgtatattgacacccctacagtttgcatagctctctgaccatacatccctcccctactgagttcaaataaagtttcaaaatcattttctcaatgtttttgctctaggtagtcactaccaatctatcagagttggctctcaagttgaaacttacttgtcattccagattcataatcagactgtgacaaagagtctctctggcatggcttctgatgtcttttttaaattaattaatgcttggaatgttgaagtcagctagaggaaatatcaagaacaggaagatttcacacattcattccaaaaactttcagaaattcatataattaaatgcatacgatgaccaaagcacttggtgtctacgagtttccttgtagctactgagctgcatctacaagcttcctcagttctctgtgagttttcatgacaactcctgctatctatagctatctgcatctgtctttctaatatataggggggaaagtcactcttaatagcttagtctttgagactacattttgtatatcgtaaattttgtatattgactttatgttacatatgtttaggctcgttaacatttatttttaggcatttcatattgttgatgttattgtaattgtatcatttttattttaattttcattatttgtggctagtgcattagtcagtttgggctatcataataagataccatacactacgtggcttaaataatggaaatttatttactcacagttctggaaggtagaagtccaaaatcaaggtgctagcaggattagtgtctggtgaggcttttttttttcctggcttaaagatggccaccttctcactgtgtcctcatgtggcctttcctcagtgtactcatgagggggaggggaagagatatccctccggtatctcttcctcttcttataaggacacctgttctattggagtaaggccaattatgacctcacttaaactttattaccccaagcacccctttctccaaatacagccacattgaaggccagggtttcaacatatgagttttaaggggacggaattcaatccataacagctggtatacaaaaataaaattacttcttatatgcagtagttctcctttcctcataggtttgctttcctcagtttcagttagctgtggtcaaccttggtctgaaaataggtgcatatagtaacaataggatagttagagagagagagggtcacattcacatgacttttattacagtatattacaatatattggcataattgttctattttattattaattattgctgttaatcttttactctgcacaattcactaaatttcatcgtatgtatgtttaggaaaatatattaggcagggcacggtggctcaagcctgtgatcccagcactttaggaggccgagataggtggatcacctgaggtcaggagttcgagaccagcctggccaacatgacgaaaccacgtctctactaaaaatacaaaaattagcctggcatggtggcaggtgcctgtaatcccagctactcaggaggctgaggctggagaatcacttgaatccaggaggaggagtttggaataagccaagatcacaccactgcactccagcctaggagacagagcgaaactccgtctcaaaaaaaaaaaaaaaaaggaaaaatatgttgtatatttagggtttggtactattcatgattgtaggcatccacttggggttttgaaacttatcccctgcaaataggaggaaactattgtttctgacttgatatgaagccttgctaaacacgcatattagttttagtagcatttttgtagattacttagaattttttacttagaccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgcttttggtgttttggacatgaagtccttgcccacgcagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcataatagcaaagacttggaaccaacccaaatgtccaacaatgatagactggattaagaaaatgtggcacatatacaccatggaatactatgcagccataaaaaacgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcgtggcacatgtatacatatgtaactaacctgcacaatgtgcacatgtaccctaaaacttagagtataataaaaaaaaaaaattttaaaaaaaaaaaaaagaattttttacttagacaaccaggctgtctgcaaatagagttttgcttctttctcttcaatctgaatgggtttcatttcttgtccgaccttcttgcattggctaataccttcataggacattgaagtggtgagattggacagccttacacttgagcttaagaaaaaaggcttcagtttttccccaccaattgtgatgttagcagaaggtttttcaagatgcccttaatcaggttgaagttgaggaaaatcccattgattattagtatgccaggaattgttaataagctccttgaagacactttgtctctttctcttcataataattgcaccaagcaatctcttgcacatagtaggcattcaataaataattatgaattatattgagaggaaattgatgaaatttcatcaattcttttgaagaatctaaaagggaaatatatttttgaaaaaacaaagtctggacacatgactcaacacatagtcattttttgcctcatgatgaaaagaatgctttatttctgtaatttttatttggtgcagagctagatatacaagatttgtgtgtgtatgtgtgtgtgtgtgagagagagagagagattgtcttgtaaatgtaattgcactaaatgaattgcataaagactattgcattctagaaatgcaaaataatatcaacagactgaatgaaacaatggtatcaaagaccacaatatataacttacctatttataatccagtccatcatataataataacctacatataaccatccgtatttaatctggtccttttagaattttgaaatgctctctagaattgcctttttttctacttcaatgagaaatatgtgtgatttgttcagctgctgtctctctgccatccccacccccagcactgtgcaacacagccccttctctcagctggcaagcacaggccccagatgccaagctgtggaagatatttatctgctgcatctggttccttagcagattcgacaggcctctgtgctggcagcttcagaaatgcctttgggcttgtcacatgttgaaaactcccaactggctgtctgaattggcaaccatgctttggctcactggagagaagagagaaatggtgctttttgtccatctactgataacctctcatgtaagtgatcgttggcttctgatctgaaaaagtacgttcccaaagggcagtgcagactttggggcttaatttcatcctcctgatacaaactcacaagtagtatatgactgagttttgtttccttggccagagaggaaatccctagcaatttggacctcagcatgtctatcctgaaattaaattcagaaagcgtcagcattttagaattggcattttaaaattaagagtcagctaatccatcccctttatttatctgatgaagaaactcaggctctgaaaggcgaagggatttggccagggtacacagcaagcaggacaaaggacgagattcaccctgggtgaatactgggagtggggaaatacgaaagcaaaaaggagcaggtatttctgtttggagaagctgtggagaaggaaccctttggagactgcatggcaggctgtagcagagcagcgagcctgcagacagggacacttatgccctaaggctgatgctgccacatccaagctaagtgaccttatgtaagtgacctaacctctaggcctgagttccaacacctgaaaacaagaaggagttaaccatagttcctaatttatttgattgttgtgaggatgaaattagatcacgcataatgtaccttacaaggctatgctcatttttttcagtaaatgtttattgagagcttaccatgtggtagacattattcaaaagacttgataaataatgattctcaatcatttgggacatgaaatcagtaaatgagggcagacctgtaaaaccaggacaagagagtgaatttccggagtggtttcctgtcgagaggcacgcagacagcgagtgtgttcttacacatacacacaatgcatctacggccgcagcatttgttctaattccctgagctgcagtgagctctggattccagcaggggacatccatagcccagacaagggaaactggggccagctcagccttagaggtgatgaatgaaaatgataaatcactcagacatgagcctgagactggcctgttctgatactcattccataaagacgaaagttctggaagggatgaccctcacaggcttcgttagctctgagtttgtagaatgtcaatgaatttcaagttctcttaatcctgaatttgcaagctgaggtcccgtggagttttgtccatgttaaagggacataattcctttctccccagggcagatcaaaggaaccaggttttgatgacttacagctcacacaaggtcatcctgggaaaacagatcctgagaagtactgcagagcttgtgaagtactgcactggctggtgtctggattctagagtttatgatctgctccaaagccagagaggtgatgactagaaggtagatatgaattggggacagtggtgtgctgataaatatttaacaaccagctccctgggggaaaaatatgtgcatatgtacatgtacataagtttattatacatttcactcatatacaggacaagtagcacacaatttacatgttatatatataaaatatacaataatctttattataaattccatatagctaattgattctcatagaatacattagttaatttctgttgaactcttgtattcatggccaagctattattgcaatccaaccattatttgacaatatcagcctgcaaataaacgtttaaatactgtctggttcagcaaaaatgtctcttacttcactgatcaacaagtgtgattgtgaaatgaatggtgcttgatattttcatttatgttaactgggagcaaaaaagtgaatggacaaaggcatatattaaaacttcacttgtttgttaatggtattagccgaatctttgttaaattcactaatagtgttaaatccactaatactgaaaaatatttcctgttatttatgttgtttatgactcaatagtcacagacagaatacagcattattaacctatcaagtctagcgaaatcatcaaaacaatacatcaagccctgacttacagcatttgccaattttcatggtataaatatttccaccatggttgatttcaaaatcaaggtaatgtcattgaacacgaaattgaaaagagattcatagtagtatatcattacataacgtttctaccatatgcttaaaatagacataacctcaaaaacttaataaaatatagtaaattaattatgaagttatggattttaaaatgttttcattgttacatatttgtatatacttatggggtacatgtgtagaaagtgatggattttatttactttcttattcacaaaacctagagaataatcaatcttattttaaaaatatctaccttacatagtgtttaaaacacagtaacatttgttgcataataattataattataaaggaggggaaaaaaacaagagccaggtgagcatctaaaaaacaactttatctaaaatgttaaaaaaattatggagaaattatcatatacaagtcactgtcctaaaacctttatatgaattaaattatataatcatcacattgattataaggggcatatattatttcccccagatgagagtctctatctaacagattagaatataagtctcagcggagtaaagtgacttgctcaagtacatccagctagcaaacagtaaggccaggataagaaaacaatctgactttaaggattgtgcaacaaacaagatatcagcagttaacaaaatgttggtctggaaaaataaaataaaatagcaattggtctgggaggaagcctgaacttgaaagtgacatctacccttggttctgctgtatgaatttgaacaaatcatatcacttatctgaacttgctacataaataaagctggatttttgtgagtctatgaaatgtaccctattccattttaaagctgtgatgctaggggcagaatggattgctaaagaagatggtgtgatctggctgctagtaacatcacaaataacaacagctcatatgatggaatgatatttggaattaaccactgtgtccaattcttatttaccatatctcccttggtagggtaaataagaattaccattcttcctgtattcctcatcccaaagcaagtttttagatcagaagcagagtaccatatgagaaattttttgttgttcaatttaaagatctatggtcaaggtgttaggagcaagagatctgttccttcccttgactatctgaaggttccacagtaaagctgataatcaggcaggcatagagtctacaaagggagaatgctgactcattgggagcaaatgtcctgcagctgctggtgccagggagcagcacaaggccatggaaggcctttctgggatagcagattttctgtttgagaaagcacggtacatcgcttggaaaattaggtgatccttctcactgtagcctgataaggatgacctgctgactatatctagatcattgcccattgcccagcaacatgtcagttccctgtctctccgtcccatggagagttttccacccattttcaatggtccagagcactgttaagcctctggaatctgttgtggggccctggacatagaaggatgagtcaacttgctagggcaaaggagaactggaccagagaaactgaagctctattaggagctcagacaccagtgggacacatctcccaccctcctcttatctagcactctgtgcactcatattatacacatcccttgagatgtatttgatcccattgggactctggacatacctctatcacagcactttttactttgtgtgctttcttcccatagaatgtgggctacttcagagaactatttgtgtcttacttcatgttgtatctgtagaactcagtatagcaactagaataaagaaggtgctgaaagaaaataacaaaactgtagaatgaatgaataaactctaaggggaaggaagtattaataggatactcggttaacagatgaggaaattgaagcacaaagaagatgtgaattgccccacagtggctaatttgagtcaaagaatgtccagaatctcaaatatatgattccctttccaatactcatttttttgacacactgttaactcagtgagttgaggtcagttaaatcattctaatttatactcttatttttacttcacaagtttctcaattctgaagtatggcagaatttgacaagttttttttttaatgataaggctgaaaccataatttttaggcaagaattctggaaaccagagggagaaagctattcaacaaagatgaataaaaagatttaaatagttgttttttgctttgttttgttttgttttgttttgccaagaatgtgcgtaggtggcttgaggatgggcactggtgagtgtgggcaggcagggcttgtgcacatgcacatgtgtgtgtggtgtgtgtgtaccttgggttattagaaaaagaaagtatggggtacggcggttggtacttctattcttccaggcccgtgaaaaatcttttgatcaagataaagtgctccagttattagtccttgaagctcaacaaataggcctctccattctaattttaaatcacaacatgtctgttgtgaatctaggctcatgttcctgtatctgcagatgcacttgagaattcatttaccatgtcttcatgtttctaaaaaggtctacatttaaactcttctggacagaggagaaaaactattatgttaaagtacttccaaggatgagtccatgggaaaaaaatggtgtctacaaatttcttgtggctcaatatctataactatgccaggcaattctcttttatttgttaaaatgctggctgaaggcctgtatagcagaaagtggcatggaagacagattggggtttctctggtgtttgaagacaatgctgcacatcccaggtcagtcatttagttggctgtgttatgaccttgaccaggatgtttccattctttgagccaaaaaattcatacttggatgaaaaaaatagtaataatatctaacatttattgggtgctttcttgacctaaacattatgctagcctttctacatcttatttaatccccatcccaagcctacgaagtcgttaaaatcctcaccattttatatatgaagaaactgaagagtttgactcacttacccaaagtcacatagtaagttacaagcccaggccttgctccaaggtctctctggctgcaggattctagtatttattcttaccacatttcaatactagtctagaatgtcagactgcagactctaagcaacatgtttaagtgtgttgaagaaagtgtccacaggcattaaaacaggaaaactgtaattggctatctgtgtgtttttaaaaattagataaattatttgagtgttaattccttatgtgcgtaacatttaatgatatctatctcataaagctgaaggattaaatgagaaaataggtaaatgcctaatttataatatttcataatatataattcctgtgcatattctaagttccaaatattgcattttggtgtatttattttggtcaccctgtcactagaactagagaataaaagttgtccaggaactaaggccactgcttccaacctcttctctccagccttgtcacctgtctggtacaaacatgagttctctgtgatttacttccagagcctttacatattcaattttcttacctgtgcatgcagttgcatactttcactaaggaggaagtgctgtggaagaaatgcattttgattgtaaaaacataagccccaagacgatgggctggaaagtagagttatgaggaagaaacaaaattgtccttgttaataaactaagaaaaatgttgtggttttccaggttacgtaaaaaagaaagaaagaaaaaagaaagagggagagagaaagaaagagataagaaagaaagcaagaaagcaagaaagaaaagaaagaaaggaaagagaaaaacatggaagggttaagtaagtgcatgtgaaaaaaatattctgtagagatagagaaagtcaaaatttttgagctagaggcttaagagtgaaatatagtcaatgagaaatcctcattgttgggaagggctgaatggctttaaaaattgagatattttatttcaatttaagatgatggcacagaccaaacatttcttttactgcttatcccacttagattaaaacacctaagtttgaaaaggaacaaagtcattacaggagagcaaaatgaaataagatatttcaacaaatttctgagtcaaaaaaattaagagaagtttggtgaatattgcaaatggaaatgctgctgcttgcaatatagtactctgggaatacaaatgaagtagtatctagactggccaggtgatcgccaagcatatttctacttcctggcatgttggaatattttgtttctctcgtttttggtgagattggctgagttctggccaagagagtgtgggcagaagtgaggtttgccactttccagcctggccctgaagcaccctgagcaatccttcatgggttctcttttttgcccactttctaagtgcagaaaatcctggagatcctggatgtggaggagccacatgatggaaggaatgtggatccaatcactcttggagaagagccactgactggaattggactgtgaggtgaacagctatcgatgtttactttgtttagccactgggattttataaacagctagtgatatgatttggctctgtgtccccatccaaacgtcatctcaagttgtaatcctcatgtgtcaagggagggaagtgattagattataggggtgttttccccatgctgttctcataatactgagtaaattctcacgagatctgatggttttataaatagtagtttttcctgcactaacccacactctctcttgcctgccaccatgtaagacatgcctgcttcctcttccgccatgattataagtttccttaggcctcccagccatgcagaactgtgagtcaattaaacctctttcctttataaattacctactcttgggtaatatctttatagcagtgtgagaatgactaatatagctagcatggatactctaacataaagtgggagccattctgtctatcagcagccccgaaggtctggatcataagttagaagaggatgggagaggtgtggctgacaatatgggtattgttaaggtctttaaatggcagcagggaggaggaatatgcagtaagacaaactgctccttgtcctcctcctcctactcctactccttctgtctctgaaaagagcatagacaactgcatttctcactttcaaaatgctagacagtacttctctaaagaaacagagtagaatgttaggagaaagctttatgcattgacatctcagtacaatgctgtcctcattgaggtgtttgctgtggttggaaggtagagggggttctgcaggccaaagccaggttccacatcatctgagagagaagctggccatctggtagccctgcactgcctctcagaatgtcagtccaaaaattctgctcagctgagacacctagtcaagcagatatagttgtaaaatagcagaggaaatgcatatgtgttccctaggccttccagtttaaacctcagtggacaatgagataccaaaaagtaagaagaaccagaaaaatgaaaaggccagtcagaatgagtaatatgctaattaacatattcgagtacatttaagaagattatacttatttgtcactgatttaacaaatatgtaatgaatacctactatgtgctaggttcttctagatggtgagaatacattggtgaagatacctgttttagtttaattttcaatagattaagtatcaaaaaaaaagaagcacatacaaaatcatgataatttcctgtagaggtaaattttctggaaaaaaataaaacaagatgacacagtttcgctgaaagggggctacagagaataaggtgatcagggaaactgtttctgattaggtagctgttgagatgagagtttaatgatgaggaggagccagccatgcaaagatcatggaacactatattttggaagcggtcaaagattgcagagttcatagagcaagaaggagcttttatgctcgtgtagctgaaggaaacaatcgctccagctagagcatggtaacggagtataagttggaagaagggtatcattttcaggcattcctcaaagaccccaacagagtgtgcatctagtcatattagagcatactaaataaaattaacaattggtcccttatttattttcagaaaatcttggatcaagagtgggaagagtcctcaagaaaatatctagtttaactacccaactcacagattaagaaacagaggcccaggaggaggtgtggaattgcctgtggttgtccagcctgttaggaggcagaacttaagggctttgtatacagtctagtgggcctcacaggtcacatacatcctcctctatctggctgctccaaactgtatgaatgcaaacagcatgagaatatcttgtggtagtaattaagtcactaacagaaattctccagcttgggtacctaaacctggctaaccattatttgaactagataaaaaccagatacacaaatcccactctaggagatgctgatttggaagcttaggcgttgagcccagaaatctctactttaaaaagagctcggccgggcgcggtggctcacgcctgtaatctcagcactttgggaggccgaggcgggtggatcatgaggtcaggagatcgagaccatcctggctaacaaggtgaaaccccgtctctactaaaaatacaaaaaaaaattagccgggcgcggtggcgggcgcctgtagtcccagctactcgggaggctgaggcaggagaatggcgtgaacccgggaagcggagcttgcagtgagccgagattccgccactgcagtccgcagtccggcctgggcgacagagggagactccgtctcaaaaaaaacaaaaaaacaaaaaagagctccaggtggttcttatgatcaggtatgctaaaataccaacacaaaatggatagagccctgactgtgagttagaaaatttagattctcattccagctccccaagttactaaccacataacttaatgtctttaagcctatgtttcctcatctcagtggtggggaaaatgccagctctgcctggctcgcagtatttgcaggaaaatcatcatcccccattatcacataattttgatacagagaaagtttagtaaataatagtgatgataactatgataagcatttatatatagtataaaagtaccttctctttgatcctcactgcctttcccattattcagatgcacaaagctgactctgttgctagtgtaaacaccagttctttactctgttttctttctattacattgttctgcctctcttcataagactttatcagctattatttaccttatttgtaaataaaacctattcttcagaagtactcatttgtcaatgaagagaccagtggaggtaactttcagacagacagatacaaggtatgggcagttattattttacaccgtattaaaagattcagaataaaatctcagaggatgcaggccccatgtttacaatttgatactttaaaaggaaatttggttcctcttaaagggaaatgattttagatgaagctcccttcccctcccatgccctttttcaggtttccctccaggatgtatgaaacactacttaagagcaaaatgtttccccattgcatcatagattctagcaaaaccccaggctggtaagagtagtataaagtaaaatcagcaagaatgatgctgaccaatcgagttctattatcccaacaaagtggaaagtgaaaagggtaaaaaaattaacctggctttaaattatgaacgcatcttagtctaaggcaaaattaaaaaaaaaaaaaaagagttttcttcgcctatgccgcctcccatcagatgacagcagctgctgaaagcctgctctgaaaagacatcaggggtgagtcagaggatcctgattgataagaaatatctaccatgattgttaagaaatagctacctcctgaaggcgaatgtgaaattaatatgccagggatttgccccctccgaagtaggaagaaggctgtgctggatcagaagaaatcatgtgggttcaaagctagatggtcttgattcttcatttggttctgacaattactatgtttgtgaccttggacaaaaacactgtatctcctcatttccaaatgaggtatctagtgctatctcacaatgaaaaggattggcatttcacttagattttaggaattactggtaacactgagttttttatttaaaggtcagtgtggttctgtggtttctttggtttgttggtattattgttttgttttgagacagggcctcactttgtcatgcaggctggggtacaatgatgcaatcacggctcacagcagcctcaacctcctgggctcaggtgatccttccgcctcagcctcccgagcagctgggactacaggcacatgccaccacgtccaactaatttttgtatttcgtgtagagacaggattttgccatgttgcccaggctggtcttgaactcctggattcaagcgatctgcctgcctcagcctcccaaagtgttgggattacaagcatgagccaccacacctgaccaaaaggttgtttttgattgacttctaagacctggcccttcacccactttaggacatagacattgggtaaaatgtgaacatgttctggttttctctctgtaccatggaagtctgtttccattaatcagagcccatacttcttcagccagtattgttcaagttgcctcctttagtaacttagagctttttcggtgtcctctgaccaaaacttacataagatgtctctctcttgcataatatatttcaccttttcacttctgtctgcttgaaaaaaaaaacaaatgaaaatatatcacaatagagaaaacctttaattaactttagttctctttttaagtaaattagttttgaactttggagttttcatttcaattttttaacacatcattggattgcatcttacaaatgccttccctgccttattctgacctataaggtactacaggacatggtcttcacccatctgtggttgctccagccagtcttgctagtgaattgtgtcctttgagttgtgcaccacagcaattctgtctcctgggcatctaaataatcttaacttttaggttttagacataaatacagaaagctgccatcaatgacagaaagaaagcatctctacaatcacttgttgatattccttatttctgagtttgctaaccttaattctacctgccagccctgtgattatagccacaaaaatcatttaaacttcttgttttccagctttccaaatctataggactctctaaaggggggtcaaaaatcacaaccactcaaatatctgggtatcacccttttacataaagacctaagtgactgactgccatcccactttccatttacatattcccatctactctttcccccatctaatgggctaaaaatcaatatctatcctaggatgtaggatagagagaatctttgttacaacaatttccttgggtaaaagctcctgcagaaattgacattaaaaatatacccagtgtatggctactattctgcagggactgtaactcactctcaagtcaattagtatgaggccaggaggaaaaggggtcatcctaaatcatttggctccaggctttaactggtataaagagcactaaattcacacaaacatggcagcatttccgacaggcaggaaagtgagagttaacacccacctagttccatccaactaatagaggctgaatattaaggcattctgctattgcttttttgctcttctttcaatttgtgtcatttctcatttattatacattattcctgtgcttgatcataatgtcactgggggtcctctgtagcatgccatatcaatgtggactctgtctgctttccagagttccttaatgcctggcagtcttctcagacgcaattcttcctttcaagttggtcccccatgtgtgtaccattaatttatctggctgcatgtaattcattcaggggttcacaccagctgagaaccacatatgggagtccaggtttatggggatttttttttaattttgtgccttgccaacccagaggaaacaattttcaatttgaattttgagtgtttgccctcgttgtgtagtctactagagatggttgattaagataccacattcaacaagagacccatccggcagtgggttgaaccagtcaaaccctctcagcctctgctgtccttgctttaagtattagcctatgctccttgtccactctcttttagacttcagctgctggttatgcatcctgctgtcatgggcccagcttgctgtcttacctttatattgtcaaaaaagtttcctttctcccaatttttccaactcttcctagtaacagtgggacataagacaagtaattttcgttccctaaacttcagttttttttcacccataaaataaaaaggttggattaagtaaaaactcttacatatctaatattatctgatttcaaatagaattcaagaccacactctgagctcatgaaacacatttcctgccccaagagttttgaagagcagaaaatggtgcctgcagaatagaaagatatcctggagctgggattagacaccgctgctatgggttacctcctatttctggcttctgcataatctgtcttctctctcctcagaaccttggcattcttctctttatcacaattcattgccaggagaggaaagaatgatgattgttttcaaatgatatggggaatgtaaagcacattgggaatagaatgtcatgcccaggatttccaaacagagagggcttttgcaattatgagcacaaagtaggcaactcaatgcagactgcatgtttctgcagttgaaatctcggctttccttctgtcctgtatttccatgtgggacatgctgaaaactatatgtctcctctgttctagcaccttactagtttttgattttccccctgtaaaataagataccagtttacaagaccctctacaaaattacaagtctgccttggcattggaatgggagcaactccttctgttaaaggtatttaacattcatcatttatcatgagtgtgcagggtagttagaaaaccgtgatatacaaggctgtgatgtccctggtctagaattaagaaactaattgagcaaatgtgaccaaggagagcagcatgcgtaaggggtgcaattaaagaaataataagctagagacgtgcttgagaagtagaacatggccatcaaattgcaagggggtagagggattaacagtaaatcaagatctttggatcaagtaaaatggggacaatggaaagcacaagctcccagctccacagcaaaggcaagactcacttcaattaagcaaggtaagaattgtgagtctagacacgccctattttgcttaagattctaattgagacccacatcctatcttcaaagccacttttcctttaaagttctcatgtaggttaaaataactcattagacttttgttagtcattgacctataaatgcagttacatggtaattgctcctggtccacttaacttaatcatttgattgtgtctctatgcttcagaagattgcacctactgggttatgacttttaacatcttttaagaaaaaacaccttttgctgtataatttacatgcaataaactgcccattttaaagtatacaacatatatttattgatgtatgtatacaactgtgaaaccatcacagcaatcaagagagtgaatatacctgccacctcctaaagtttcatcatgtcccttggcaatctttccatcctgtccttccctgacccccacctccagtaacccctgatctgctttctgtcactagcaattagtttacatcttcttcttgcttatataaatggaatcgtatattatgtgttctttctttgactgaatcctttcagcataattattttgagatttatacatgttgttgcatggattaatagtctctttttatattgcagagtagcatttcattgtgtagatatatattataatttgtttatccttgtgcctgttgatgggtatttgagttgttttcagtttggggcaattaaaaataaagcttctatgaatactgcatgcaagtctttgtgttgatacgtatttccttttctcttgaataaacatctaggaatagaaaggctgaataatatggtatatatggtttttttttagaaactcagattattttccaaacttgtacagttttacattcccagcagcagtgtatgagcattctcatttttctacatcaccagcacctggtatctttccatctttcttactaaaagaaaataaaaacttcaaagatgtcatctgttcactagtcaagtgcctactacatgagaaggcacagtgactcgcccatgtaatttcttgtgacaaccctatgaaacaggcagacaagaaaatctacctgctaagatcacagaaaacaaacaaacaaacagtggagctagaaacaggatttggatcctcagtctcagtagtcatctttctatgatgtattttgattgtcagaatagctatgataggagaaaaggcaaatgcctttaaacagaccacttagatttggtttgaatccatggtgagggcaagcctacaatatgtcagttacaattttgatgccaatgtgaatattatcttctttaaagctcatcctaagcttatgagacaagggctttatttaattattcatgtagattgggaaacagaggatcagggagattaaaggacttgctcccagtgttacatagctggtaagaagatgtgtaggcacataaataattcaaatgtatagctccagagttcttttctgcattacagagttgggattagtttacaattcaggttgactatgtgtttctatataatcatctgcttcatttccccaggtatagaataaaattggtaaacattaaagcaactatcaagctactgtatgcctaccaaataggacatgtcattgacctggagagggtaagaggttgacaactcactagccttgcccctcactaggctttctgcagttttttcctgcctggcagattctacttccttcagaaaggttgaaaatgacagaaacttctttttccaggatttcttgctgctgggacatgacatataacccaatattgaccaacgggatatgaagaaaatatatgctgatggctttggaaaaaaaattattctcttataaagaagagatacatgagatgaaatgactctcctatttgttgtctctgcaagcacatatgtggcagccattctgtaattctgagcagacacattgctatcacatgaaggatggtggagtagaaaggtacaaagcacattcatgagcactgttgagccattaaatttaccagccttgaagctgccctcctgcacacttcttacaatacgagataaattttccttaccatttaatccacttttagtttgactttctgtgccatgtactaaagcatcttaattgattcaacttaaaaacgacacgccaggcaccagactaagtaccttcgaataagtgatcccatttaatctccaagacaaggtcatgggataattattgctaagctaattttgaagacaaggaaacagaagctcagagaggttagatgatccacgcaaccttaagtagataacaaaccaaagactgtttgaatccaaggtccattcattttttaattatactatgacaactcactggagagagactgtggtataaatgcaaatttaattagaagatatattaactagttatgaagacagcaacatactagctattttattaaggtgacacggttcaaatatatattttatatatatatatatatttatattatatatatatatatatacatatatatctcctgagtctcacagcaatgtttaaaacatccagataatcacattctttcagttacatttttaaaaactacatcttaagtgcctgctacatgcaggcacacaagctctgagagatacaaaacttgagatacaagaaagtagaagacatgattcttgcccatgatatctgtattggagagaataagtaaatactataggacagacatctgagtagcagtattttattaaatgttattacaaagtgtttcataattcccaatattttcattgtctttgaaagttcaagaacactgtcacacaaacactttgaggagaatgactagtttctgtgtatgggcggggggaatgtctgaagggaacagcccttagagaaggaggagggggcaactgaatggatcagccagaaggatgcctgcaggtgttggtcgaaatcattcctgatggcaactgtgaggccctccccagggggtttcacccaaggatcttgagactggatagaattgatgcagcaggctgtgataaccagaagtgtgattgaaacttcatgagaacagagattcacagtgaaatgaaaaggatacgaaaccagcatgtggtaacccaattcttcccaatataggaggttctcagtggaaaataacaaaacaaataaatttaaaaaggaaattttcctaccaaaccaaccagttcgaaacagtgatgtgtatcagaccgcagaatactctcccccaatggaagctgtaaaaatcctctccacctgagtcatttaaaagtagcctggttaaaataattggaaatgtgctccagggaacaatccattagtggccaaggatgtgcaagataaattgatatgtcccttaaagtcctactttccatagcacaacttctggggcattaagttttgatcgttgccttctttaaaataattattttcttactagttttattttcttcaaagcactgcctttcactggctgagtattaatacagaaagtgctgtctagagtgaaaatagatctcttcagggtcagagtaaaacactctgctctggtctgtctctcgtatattacatgtcttctattgagatgatggagggcattcaaacgtctttatcagccccctttggggagccttgaaaggactgaaggtattactggcttcactcatcagttcattgacctggcctggctgtccgatttatctatattcagatgcaactttggtcacaggctgaaggaaatcatgagttttgtggggagtagatggatcttttcctgagattcaggtggtttggaataatgccgaccacagtactcttaaaaactaactacaaatgtatcctttcattaaaagataagattcaaatccagaatcagggccaagcaagcaatctggaacctctaggggaagcctcaataacaaaatgcctctgcatctcagtctagctaaccctgtggactctaaattgtgagaattagcaaagaaagataaaaggtcctgtggaaatgttcccctaaaagcagttttagttttcacaaactagtaattttgttattttgcctaccacagacattttcccttttctagctttcttatttgttccctatttcacttttgtctttattgagcagccctttattgaatgcatgtcatgcagcagacactctgctaaacactgggagtgcaaagatggtgctatggtctgaatgtgtccccctaaaattcataggttgaattctaaccaccaaggtgatggtatttgaaggtgaggcctttgggaggaaaacaggtcataagagatctgccttcatgaatgaaattaatgcccttgtaaaagaaaccgcagagaactgcattaccacttccaacatgtgaggacatgaagaagttgctctctgtgaggaaaaagccctcaccagacactgaatctaccagcacttatgtcttagacttctcatcctccagaactgtgagaaacaaatgtttattgtttataaaccgcccagtttatggtattttcgttatagcagcagaaaagactaagacagacaggtaatgtgcattccttgttcccacggacatttttctttaaaattattctttgtagagatgaggtctccctctgttgcccaggctggagtgcagtggcatggtcatagctcactataacctcaaactcctgggttcaggcaatcccctcagccccctgagtatctgggactacaggcatgtgctaccatgcccaactaattttgaaaatatttgtagagatgggctcttgctgtgttgcccaggctgatctcaaagtcctggccccaaaaggtcctcccacctcagcctcccaaagcactggcattacaggtgtgaaccattgcacttcttccatgaagaaagaaatcctctttcatgtttttacttgttaagtacaggttaagttcctacaaaagaccccaaaatacagttgagttatgtaagatagaggtgtttttttcttttccttttttcatgcaacagtttggagagttttgttggggatcctctgcaccataaaattgtaccaaaatgcagtttttgctaactatgtatttgtcatttcctaggaagttttcttcctcatcacagttgaagataactaaaacaaaagcattggaaggcccctgatttccctcagggaagagatgcataaattgcatatttcccagccatccctactgagaactggaatatctgcagtgataggtcatgtattctgtaaaatccagagtatcctttttccaaatgtaaagggaaaagaacaaagactggggacagttggaatctttgctgtaaggacaaagtggaagagacactgaaaaagaaaccggaagagctcagtaacttgcccagtcgctatggaaagtcatttagtcctcggtttcttcatttttaagtgaggagttgaaggaaataattccgagatcctttcaacctcagtgttgtaggagactctttcccacccacatctctatctctgtctccactttcataattcaaaaacgggcatgtgaatgtcaatgagagtgctttctttccttttttaattctctatctttctaaaaggaacatgaagtgtcgatgctttcaccttgataaactgtgaatgcgttttccatcattccccttgctctcagcctcctctcattctagcaggtgagccgttattcctgacaaatgagtcacttcagagaatgttcttggaggaaagtttgggaaaaagcaaactaagacttaaaaaaaaagaaaagctatttccttgcctttttttttttttataaaagtaagtagatacacatgaaaaaggaaagggaccgaaagtaagatggtagaaatgagtagagatggcttgtacagtagagtacaatggacactcgctgacgggatgaaaaaagagtgaggaatatggaagaagaaaataaaaccttttttcaataaagtgtattgtgatttctatattaaatttagagaaatattacattttatatgaaactatcctatattgcatatacagcttctttaaaaatatttataacctaaagagatgattattctacttatcttttaaataatagctttattgagatataatttacatagcacaaaattcagccattccaagtatgaactccagtattatttagtatattaacagggttgtgtaaccatcattactatttaattttatagcatttttgtccccctcagaagaaactctgtacccattagcagtcactgcctgaaactcctttctcatccacagtccttaatctactttctcaatctactttctgtctctatgaatttccctattatgaacattttatataaatggaagtttacaatatctgggtttatttctggattctcgattcttttccatttatctatatgtttattcttcagtactacatgatcttgatcactgtaggtttgcagtcagttttgaaatcaggtaatgtgaattcccctaattcaatttttcaagatttgtttagatattctgggtcttttggatttctgtaaaagttttagttctagcttgtcaatgccttcagaaaagggagatgagactttaatagggactgtgctgagtgtgtacatcaattaagccttctgatccatgaacatgagatatctttccatttatttagagttttaaaatttctttcagtaatgttttatagtacttatcttacacttctttagttaaatttgttcctgtgcattttgtctttctgatgccatcataaataaaatattcctaaatttcattttcagattgttcatcaccagtgtttagaaatacagtggatttttggatattgatcttgtatcttgcagccttgctgaactcatttattacttctaacagttgtattgtagattccttaggattgtctatataaaagaactgcaaaaacatttttactttttcctttccaattgggatgcatttatttctttttctttccaaatttccctggctagaaggtccagtgcaatgttgaatagaagtggacatctttattttatttctaagcttagagggacatttttcattccttttgccattaagtgtaatgttaagtgtgggagtttggtagactttatcaagctgaagatgttgctttttattcctactttgtgtgtgtgtgtgtgtgtgtgtgtgtgtgtgtgtgtgtatgtgtcatgaaaggtcctgaatattccatgtgcatgtaaaaagaacatgcattttgctgttgttggttgaagtgaactacagatttctgttaggtctagttgatttatacttttgtacaagttttatttttccttattaatcttttgcctaattgttgtatccattactgaaagtgaagtatttaagtcttcaacttccattgttgaattgtctacttctcccttcaatttttttggattttgtttaatgtattttggggctttgttgctagatgcatatatatatatataatagttatatcttcctaatagattgagtcttttatcattataaggtctttttaatactctaataacattttttcttagagtttattttgtctgatattagtataacactcaatttctcttttggttgctatgtgcaaggtatatatataattttccatccttttactttcagctatttgtgtctttgaaactaaagtgagtctctttagattttaaattgtgactttgaatctaaaaagtatgatagcattaggtttttgagtttcattctatcagtctctaccttttgattgaaatgctttaatccaattacttttaatataactactgctaaggtaagacatttgacattttactgtttgttttctatacatcttacttttttgtttctctatttctccattactcttttcttttatgttaaacatatattttctagtacaccatctaacatcttaacttaaaataatctacttcatgttaacaccagcttaatttcagtgtactacaaaaaactttgtttcaatgtagctccattaaccacttcctttgtgcttttattgtcatacagattacatctttatactttatatgcctatcaacacagttttattattattgctttatctgtgtatcttttaaacttgataataaaagggttataagtaaaaaataagtttatactgtgttttgtatttagctatgtagttatcttaacctggtgttctttctgtctttatgtggattcaaattaccatctagtattcttttattttattccaaaggatattgtttatttttatttttattttagtattttttgtagggcagatgtactagtgatgagttctctcagtttttgtttatctggaaatggcttaatttttctttatatttggaggttagttttactgaatatagggttcttggttgacaaagcacatcaaatatgtcttcccattgctttctgtccttcctagtttctgataagaagtaagtttttaatattattgaagatcccttgtttgtaataaataaattacttttgtcttgctgcttccaagactctctctatctttatttctcagcagtttgactatccatccatcactgaggtatccatctctttgtttatcctacttggagttaattgattttcttggatggacagattgtttttcatcaaatttaggaagtttatggccattattttaaaaaatattatttctgcctctttctattcttcggagcctctcattatatgtttgttgatatgcttggtggtgtcccacaagtctctgaagctctgctcatttttttcatttatttttctttctgttcctctgactggataaatctcaaaatttttgaaatttctttttaatatttggaggttggttttactgaaattcactgattctttcctctgtcagctcaaacctgcacttgagccccactaacacacattttatttaaattattttacttttcaactccagaatttttttcttctccttttttgtaaataatttctatgtcttaattgatatttatatgtgatgacacatggttctcatacttttctttaatgcattagacatgatttcctttttctttaaacatgttaatagtagctgacttaaatctttatcgattaagttcagcatctgggctttctcagaaatagtttccattgacagtttttgggtttgattttgtttttacccctgtgtattggccacattttcttgtttttttgcatgttgcatgatttttgtgttgaaactgggcatgctaagtaatacaatttggtaagtagataaagcagattttctcctccttagggctgtttttgttgttgttgctcctgctgtttgtttggtaactttcctggtctaattttgtaaagtttgtattctttgtcatgtgtgtttaattagcttagtggtcagctaatgattgaaccaagatccctaactatttggaaccaattaacttttgttgagaggctgtgtgtgtgtttgtgttgggacatgccttcaaggctctggtaagcaattgataattgtcttaatcttcaccttctgctgtgcaaagcttcaaggtaagccagaagtgagaaagtggagtcttctatggcttttcctgtgcatgcacacagctctgcttatgcatgtgtctttctagattcccgggaatatgtcagaccttttcagagcaccctagggacatctcattctctaatttctctgagttcttttggccagcctcttttagctacagctgatactgccacctcaaaaagctgcaatgttaaccaattgccaatgattatttttgacaaatgtactgaatacagggatgttaagacagatcaagacctgagttaaatatagctcttcaggtattttctgataggttaaagagtgacgatttgctggagatggagcttttaagaaaatgctgaactttccaaagtctgctggactgctgcttttcacagctactgtagttgaaagtctgttggttttcaaggttgaggaaagagagatgggaatagggtaagtaaaaacaccaataggcttactgttcttattaagacatatcaattttcttgaaataaccctcctcaggttgttacaaaccttttattaatttccagagtgcagaaaactttgtttctgacatttttgccagtattgacattgcttatttgaagaagcatatttttggagccttactctactgttctgtaaatgccactttctatcatgtacttttgcaatagatctcctactacattgccactggcacctacttgatgccaaataattcttggatgtttgggactaagttcctatttggttctctcaaggttgaattattctaaacagatacacttttacttgggtccagctttcattacctttagaatctaaactgggttatagattaaacatgaggccctctaaagacaggtttgggagagcagaggaatgtccgtaatttcttgcagccctattttcctcaacaccctctgttattcataaacctcacttgactctttttaaaatgaatttttctgtagtctgttggttctgagtggccagcttgaaggattcctaagttatagttgctggaatgaaacatccttctcaatttcaaaaagttcaaattaagcccttctctccctttccccacccaggacagtatattaagaacttaaggtatcaagccaaaggtgaagctcctcaggagacaagggactttagttatttctgggcggacaatgctgtctctagtttttgtatctattttatatcctatcaatattctaaatacttgactttttttctattctttttttatttttatttttttgagacaaagtctcactctgttgcccaggttggagtgcagtggtgcaatcccgactcactgcagcctcaacaatctcctgggctcaagtgatcctccttcctcagcctcctgactagctgggattataggcacacaccaccaagcccagctgatttgtgtgtgtgtgtgtgtgtgtgtgtgtgtgtgtgtgtgtgtgtgtgtgtgtgtgtgtatgtattttttgtagagacagggtttcaccatgttgcccaagctgttctcaaaatcctgggctcaagtgacccacctaccatggcctcccaaagtgttgagattataggcatgagccacaatgcctggcatctttttttatttttacaataatttatttaacactgaatatatgtcaagcatttggttggtcactgataacataaactgtattaaacataaaaattttcctaacatttacattttctgctcccaatatgagatatactcttgtcctctaaccagctctgcctgtagcttgtcatataatcttatgggagtctttttccccctggtctgccttacacttctcaaatttaatatggtaggctaacattaggtatatttaagaccttttacctccttggatctaatatttcatatcacctctttacccttatttcttcctctactcaaaaagttcaacatgatgaaggaataaatggtaagtctttatctttgtttaagacacattttattgaacactacatttcaggaactgggccaagcactttatagaggctctctctctctacacacacacacacacacacacacacacacacatatacataatacacacacatacatatatacatacacacatatgcatatgtatacatatatatgtgtgtatgtgttatataaatatagaatctctccctctctctctttttttttttctcttgaggcagggtcttactctatcacccagactggagtacagtggtgtgattttggctcactgcagcctcagcctcctgggctcaagtgattctcctacctcagtctcctgagtaggactacaggtgcatgccaccatacccagcttattttgtttattttttgtagagatgaggccttcctttgttgctcaggctggtctcaaactcctaggctcaaggattcctcctgccttggcctcccaaagtgctaggattataggcatggtccaccatgcctgatcactgaaatctttcttacctttctacctgtccctcatactttagtgttgctatatagcgaatataatatgtgggttcttccttctcctcctctattttttcactggttttggagttcttttttggaacagcaacatcttatcccattccctttccccctaaccagattccaacaagtaataaaaatataatatatggtaaatagtgaacaacagtctttattaatagaccttggtaacattttctctccatgcatccctactaggactgaattggagaactgaggaattacctgatgccagaaagagcaactcttagcatcttacctcaagtccagacattgaatctttggagagaatttattctgcaaagactaagtatacttatcctacagtagctactcttgtggaggtaaacaattgtgtcttgacctagaaacaaaatcttggtaagaatgcaagatgtcagagtgttcagaagagagtgaaataggatttatactgtctttttcaatgcagcgacttcgatatgactcaataaacaccagtctcttacctgatgtatctcctgatatgatgtcttcccagtcagatctatttctcctcctcccttagaaagagggaaataaggggtagagagccacagcttaggaatggaactaagagaagaaacaagcttctccaatgtattctgttgccactagtttctagttgttgttgtttttaaatacagtttaaaccccatcttctctataaaccttacattagaaatccaatgatttttatcttccttccaacaccaaagtcaatatgacttattttaaaatacttcattccaatgcttaacacaagtagaaagcaaaaaaaggagaaagaaagggaactacacatatttggtaaaaatatttttcaaaaataaaggcaacaataaagtcattttgagacaaggaaaatttgaaagaatttgtctcttacggacctgcactagaggaaatgctagaagatgtttatcatgatgaggagaaataatatcatataaatactccaaatttcaggaaggaaggtagagcagtatattttaaattctataaaagagaatgtatttaatataataataataatacatagtgtggcttatagtatatgtggaagtgaaatatatgataaaatcgcaaatgataagacaattggaaaaaacatttatattattataggttttaaactaattttaaagtcatataatattatttgaatatatacaaggataatgtaatctctatagcaataactaaaagtcacatacacaaagaagtatattaaaaggcaagaagaaaagatgaaatgaaatattaaaacagtataactcatcaatacaaaaggaaattaaaaacagattaacataatagatagaataaccaaaaacaaatgaacaaaaattctgaagcatagactcaaacccaagcatctaaataattttattaaatgtaaatggacgaaacatttcaactaaaagaacagattgccatactgcataaaaaataagactaaattatatgctgctctaaagatttagtggttgaaaactaaaggataaagaacaatgcaaaattatgtgcaaggaagccagtgtggttatattaatgaccagactaagtcaactggcaagaggaaaagtagtctcagaaaataaaagacattcatattgataaaaggaataatgtatcacaaagatataaccattctaagtatgtattcatctaataacagtgcttcaaattacatgaaacagaaactgacagacagaaaaagaataatagaaaatctacaagtatagttcgtgattttaaaacccttttctcagtaatttatagaaaaaaatggggaaaaaattggatcaaagactcagctgttagaagatctaaacagcattatccaccaatttcatcttattgacatgtttagaagactacactctaaaactgaagaatacatattctttttaagtgtacatattatgttcacccagaaatagcataggcttggccataaaattagtctcaataaattttaggagattgaaacaaagggaaagtttcctatacaccagtattaaattataaataaataacaaggtatctttaaaccttcaaaatgcttgcaaattaaaataacccatggattaaaaaaatcacaagagaaaacaaaatgtttctcataaacagaaatgaaaacataacatcaacaattttttgagcaagatcttttgtacattatgatagtgtgtataattactttccagaacttttatttgcagtttattttggagttaaacatacatgactttactcaaaaaccacactctagatatttaaacaaggtaaatgaaaatatattctgtcaagaagttgttcataagaatattcatagcattcatccgtgttagctataaattgtaaacaatccaaacaatcattaacaaattaatggatttatgctatagaaagattctaggaagatggcagagtaggaatcaccaggaatttctacccccaactagagaacaattgcactgacaaaatctgtctgatgtaactattttggaactctggaatctattgaagtctttcaacttctagggaaagccttgaatagtaaatggtggttaatttcagttaattttacctcttagctcagcagcacctacccatttaccattccccatccctgtggcaatcagcagtgcatgtattccaggcgcatcttgcatgcaggttgtgggagccaaggtgggcaaaaagaatcctgtcctcaaaaaacaggcattctatgttctgattactgattgctgcttcatgggggagcagacacaaaagcaggtagccattattgccttcctgccccatattgttgcaaacctcaccctttatagctgaagtaacttccatgagatttaaagggctgatgcttttcctccaccattatcttgctcttttcccccctcttgggagacagatgttgaagactagggcattcaaaaataaactgcatatacaggagaaattagaaaagcaccatacatgcccagggaaaagtataggctcagaaaatacctttgaagatcttaagtttatacctcaggcttatcttcagaatagagatggcctgtaacattattttttaaaaagcaaaacaaaaacgagcaaactctgaggaaaagggagaatctgatttccaaaattacttcatagattcaaaatgcccagttttcaaccaaaaattataagacatacaaagaaacaggaaataatagctcattcagagagaaaactaaaccaatagacattgtcccagagaaagactagttaggtggacctagctaaacaaagactttaaaacaactgtcataaaggtgcttaaagaattaaagaaaaatgtggaggaagtcaagcaaacaatgtatgaagaaaatggaaatgtccataaagagatagaaaatcttaaaaaccctaaaaataaattttagagcttaaaagtataataactaagatgaaagttttactagagatatttaaaggaagattagagcaggcagaagaattaaaaaacttgaccatttgaaattaacaatttgaaagaaaccgaaattatcaaatttgaaaaacaggaaaaaaaatattgaagaaaatttaacagagcctaagggacctgtggggcactatcaagtggaccaacacacgcattttggggatcctagaaggagaagagaaaaagaaagtgacagagattatctgaagaaataatggctgaaaactgctcaaatttgatgaaagatatgaatataaatatctaagaaactcaatggactcaaagcaggataaattcaaagagatccacattgagaatctttttttcccctcctgctatactcatctgagacaccaagaatctcaaaagcaatgacagagaagtgacttgtctcatatgaaggactttcaatgatgttatccatagatttctcatcagaagctttggaggccagaagacagtggactgacatctacagtgctaaaaaaaaaataaaactttcaaccaggattctatatttaaaccttcttaaaaattgagagaaaacttaagacattccaagacaaataaaagctgaggaagtctgttaccattagatcagctttgcaagaaatgttgaaggaagtcctgcaggttgaaatgaaaagatgactgtaactcaaaatcatatgaaaaaataaatgtttcagtaaaggtaaatgcacaggcaattacaaagctagtattattgtaactgtagtttataacaccatatttgttttctaaatcatttaagaaactagtacaataaaaattctttatgtttttggacacaaagcctgtaaagatgtaattttatgatattgataacggaaagggttgggaatggaactgaaaaaagcagagtttttattattgaaattatgctggtataaatttaaattagagtgttataactttaggatgttaaatgtaatccctatagtaacacaaaaaacaatagttgtagaatatacatacaagggaatgagaagggaattgaacctttcatcacaagaaaatgaactaaacacaaaaggcagttaaagcaagaaatgaagaacgaaaatctgtaagacatatagaaacaaagcaaaataacctaagtgaatctctctttgtcactagttactttaaatagaaatgaattaaactctctaatcaaagacagagattggtagaaatatttttaaatgactcagctctatgctgtctgtaagagactaactttagattgaaagacacaggtaagttaaaaatgaagtatggaaaaatatatttcatataaacagtaaacaaaaaagaagagtgagacaaagaatgaaattatatattaacaaaaagttaaatacaacaaaaagatatgattattataaacatttatacatctaataacagacatcaaaatatttgaagcaaaaattaacagaattgaagggagaaataagcagttctacaacgattattggaaactttgatatccccttctcaataagagatagaaaaagcttggcagaagataagtaaggaaatagaggacttaaataacacaataaacaaaatatatctaacagacatgtatagaacactttacccagtaaaaatagaatacatttttctcaagtgctcatgaaacattctccatgacaaaccataggttagatcacaaatcctcagtagattttagaagataggtatcacgcaaagtatattctttgaccacaccaagatgatggtaaaaatcaatcgcagaaggaaaactggaaaattaacaaatctgtggaaattaaagcacatattcttaaataactaatgaatcaaagaggaaatcacaaggaaatttagaaaacacttagagataaatgaaaatgaaaacacaacataacaaagcttatgggactcagcaaaagcagtgccagggaagaaatttattgtgataaatgcttacattaaaaaagaaagatctcaaacaacctaactttacaatccaaggaactagaaaaaagaaaacgaactgaacccaaagctagcagatgaaagaaaataataaatatgagagcagggataaataaaatagaaagtaaacaaaacaacaaagagaaaatcaacaaagccaaaagttagttctttgaaaagatcagcaaaatggacaaatctttagctacttggcttacaaaatggaagattaaaattgcttaaataactgaaagtggggacattattgctgattctacagaaataaaacacattgtaagagagcattataaccaactgtacaccaacaaattggatgacctagatgaaatggacaagttcctagaaacacaaaacctaccaagactgtattacaaagaaatagaaatctgaataaatctataactcagaaaaagattgaatcaggggagtgatggcaagtgcctgtaatcacggatactcaggagactagggtggcaggacagtttgaggccaggagtttgagaccagactgagcaatatagggagaaccccatgtctaaaatattaaaaaataaaaaatagctgggtgtggcagcacctgtagttccagctactcaaaaggctgatgcaaaagaatctctggagcccaggagtttgatgctgcagtaagctgttattgtagtaaccactgcactctagactgggtgacagagcaagactcatctctaaaaaataaccatcagtaatgtaatcagtaattgaaatttcccaacaaaagaaaagcctggacttgatttctttgctggtgaattccaccacacacttaaaagagaactaataatgattattctcaaacttttccagaaagttgaaaagaagggaacacgttctatttctttatatgaggccaacattcccctgatatcaatgccaggtaaagacattataagaaaagaaaactacagactaatattcttgtgaatgttgatgtgaaaatcctcaaaagagtactagcaacgtgaattcagcagcatgttaaaaggattatacagcaggttctcattataacattgattagaaggaaaaaaaattagttcctgactgggaccactgtctgtgggagtttacacattctctccaaatctgagtgggatttctctgggtactctgctttccccccacatcccaaatatgtgcacatcacgttaaatagcatgtctaaattgtcccagtgtgagtgtgtgtgtgttgtgtgtgtgtttgtgtgtgtgtgtatacacatgcacaagtatgtatatgtgccccctgcatttataatctcataaaaaatccttgagaattaatttaaccaaggaggtgaaagacttgtacattaaagactacaaaatattactgaaatgaagcaaacacaaataaatgcaaggataccccatgttcatgggttgttaagacttaatattgttaaaatgtccatactaccaaaagcaaatttaatgccatccctataaaaaatcccagtgatttttttttgcagaaatagaaaaatccatccaacacttcatattaaatctcaatggaccctaaataggcaaggtaatattgaaaaaaaaaaaagagcaaagctagaggtatcacactttctgatcttaaaacttactacaagtgtatagtaatcaaaacaatgtggtactgggataaagaaatacatatagaaaaatggaataggatagaaaactcagaaataaatcctcacagatttgatttttgagaagggtgccaaaactactcagtggggaaagttttgaaacttgggaaagtttgaagatttgtcttttcaacaaatggtgctgggaaacaagagattcacatggaaaaaaagtggttagatttttagtgaacaccatatataaaaattaattcaaaatgcatcaaatacctaaatataagctaaaactataaaactctcagaagaaaacatagagcaaaaatttcacaacattggatttgatgatgatttcttggatatgccatcaaagaacaggaaataaagaaaaaatagacaaattagacttcatgaaaattaaaaacttttgcacattaatggacattatttatttatttatttaagatggagtttcactcttgtcgtccaggctggagtgcaatggtgcaatctcagctcactgcaacctctgcctgtggggttcaagcgattctcctgcctcagcctctggagtagctgagattacaggtgcccgccactacacccggctaatttttgtattttcagttgagacggggtttcaccatgttgaccaggctggtcttgaactcctgaactcaggtaatccacctgccttggtctcccaaagtgctgggattacaggcatgagccaccactctcagccaatggacactactaatagagtaaaaaagcaacctatgatatgtgagaaaatatttgcaaatcatatatctggtaagggattaataatgcagaactcctaaagctcaacgacaacaaccacaacctgattcaaacatggacaaaggatttcaatagatatttctctaaagaagatacatgaatgaccaatagcacattttaaactgcttgatatcactaataattaggtaagtacaaatcaaaaccacaagatgccaccttgtatccattagaatagcccactgtaaaaaaacaaaaacaaacaaacaaacaaacaaaaaacagaaaataacaagtgttggtgagaatgtggagaaattagaacttttgtgcacttttggagggaatgtaacacaatacagccactgtggaaatttttaacacttcttcaaaagattaaaaatagaattaccatatgattaagcaattctatttctgggtatatataccgaggaattaaatgtcagaactcaaacgtatatttgagtttctgttcgtcagaactgaaacatatatttgagtttctgttcgtcggaactcaaacctatatttgagtccctgttcatatcagcatcattcacaatggctaaaatgtggaagcaacccaagtgtttcttgacagaagaatggataagcaaaatgtcttgtgtatctgtataatacacacacatgcacacacacacacacacacacacacacacacgcacaccacacaatggaatattactaggccttaaaaggcgaggaaattcagttctggaatatgctactacatggatgaaccttgaagacatgtttagtgaaatgagcaattgaaaaaaaaattctgtatgattacacttaaatgaggtaactagagtatcaaaatcatagagagaatagaatggttgtttcaaggtttgtggggagggggaataaggagttgtttaatgtgtatagagtttcagttttgtgagatgaaaagagttctggagatggatggtggtgatggttgctcaataatatgaatgtactggtgaactgcacacctaacaatgactgagatggtaaattttatgttacacatattttaccaaaatctttttaaatgggaaaaaatgcatgctatatacctaagtgaaatgctacttcacatcttccagggctgcctgttcactagttctccatccatctggttttctttccaatttggagggtgtagagtgtgaattctcacaactatatctgttcaacttctatcttcagtattgcttataatgtttggagcagaaaagatgcaccattcagcctgctgtactgaatcttctgtatcttcccttggccaccaccttttgattcttagtttaactttcttatccttcttgttgttggctgttcttggtgatgatgatgatttcgttggctattttcaaattttttgtttgttatttttattgcatttattgtgtattctggaaaataaaaatcctgatctagttttattctgtcttcttaacccagaaatatctctcaatatttaaatcaaaatgtttttattataataaagcctattcctcttggctactttccttacctatcttaaaggcatgtgtattatgagtgttccttattatttaatctttgggtaggcccttaatcactagaaaaatattgtatttagattgttagttctatgttttggctcttcaaatatgccatctagggaagtcacttaactgaattttgttttctcataagcaataaagaaatatctgttttactcacgtgatatatttttgaaagtatcaagtgagatactctaaatggaactgctttgtagattctcaaacattatacagggtacaggaatcgttatgatgatgattctatgatgatgatgatgatgatgatgatgaattgtttttcagttaatagggaaatgaaaaagctcaacagaaaacattaaactctctcaacagtttggcttgttgacattcatggtgacagttattgtcccatggatgtccaaagggttgagggctctccttttattaaaacaagggcaaggcctggtagaagcataagaaactaattcgaaaaccaattgcctgcatttgcaaaaagcaaagccacagttcattttcaattaaattatttttagtcttatgcaataaccaaatgcagttaggtcatacgttatggagaaaagaaaaatgcagcatcacttgtgttatttttagtgccagtggagcaactgaatacaaagcaccattttacttttttcctagtttttttcctgtgagttgattttcacataagaaaagaaacgcggctatctttcatatgcatcttatattttcccaagtttctaggcttgtaccaaggcagagttccatccatattccatggcattccatcctgacaacttctgtgacaggaaaatctagggtactttgtaaaatattgaaggtgtatatgtaccacattttctttatccagtctattactgatggtcatttaggttgattccatgtctttgctattgtgaatagtactctaatgaacatatgaaaatactatgcagacataagaaggaatgagatcatgtcctttgaagggatgtggatagagctggaggtcattatctttagcaaactaactcaagaacagaaaaccaaataccgcgtgttctcacttataagtgggagctgaatgatgataacacatggacatatcgttgggggaacaacatgcactggggcctgttggagggtggagggtgggaggagggagaggatcagaaagaatagttaatggatgctgggcttaatacctgggtgatgggatgatctgtgtagcaaaccactatggcacaattttacctatgtaacaaacttgcacatcctgcacatgtactcctgaacttaaaataaaagttggaaattaaaaataaaaaacaaatacaaatttcatagtaaaaaaattgatggcaatttccttaaaaaattgaaactagcttttcatagcattgttgaacattcaaaagacagtggataaatgtcaacctcctggaatgctatagaagacaggattttctagttgcacttttgagtatggaattatgactccacttactaagtatctttggcaaatttcagtttcctattctatgaatgggaagcataatagaacccatcgcttagggttattgtgaatattcaatgtgttaataggtccaagtaacttaataagaccatggtgcctaatcagcattcagtcaatgatattgatgataacgagaccataatgatggtgtttaggcttcatttacttttctactgacttattctacaaacattttcctgggtgatttctgtgtgtcaaacatgagatcagacatccttggctctcaacctcctaccaccatgtgtgagctacataatttctaatatccttccaccaatccttttaaaaatatatatatctgtgtttttcctgcagtgtttccagagactcttagtggtctcctcaattctagtctaacctcttccagtacacattctgctctgatgtaagagagatcattctaaatcaagttgcattctgtctctttccttgtattttcagtggctttacctcatttgtgttaaaatacaaactcttagcatgatatctatatctgtccaggatctattactgactctttccagttctgtttctgactgcatttccttacatatatcctaccctgtgaactctattgaaataactttttgaaatgtgcagtgtagtctaattccccagtgtttatgaggactagccttcttgcctggaaatctctttcttgagcacaatccattttaacactaagttagcattctcccctatgggccctcccaatcatgcagctcggatctgagaatggataaagttttgttgggtaaatttgcttttcagtctcccccgtttgattgcaagttatttgaagtctgtaactttgactgacacagagaaggtgatttttaaaaaaatgctttgttaaatgaattactgagtaaagaaatgaataaaatatcatctttgttcattcagaatttataatatggtacatagcatctgtacacaatgtattaatattaggtgtattaaaaagttaattttaaatataaaaaaattaactatgaagagaagtcttcaaatagagaacatactttagaaaagccagtctcagcaattgaaaatctgagactgacaataggaagtcttcaatcccgatccatagtatctgacactttgctcaacctggctttcactctgtttttagaatccatctcattttccctcatcttcccttgctggcttgggtatcgcatcacttggactgcgagagtgtgataaacttgttactactcagaaagaaactgcccttaagaccttaatttgtaaaattctgttggaaaagtattacaaacaatgacgattcaaatgtgaagcttttctgtctttatattaaccatatcagatgactatacgaatatcatgaagacatcattagatgacagatagattgatatataatacagtatagaaatgggcacacagacatatatatatataattgaaataatttttgttgacagatgagtaataggcttaaaataaaatcataattcattaggtaattttggtaagattctctgctgactgccaaattgttcataaaatttctactgggatgaattacttaatacactactttacatcaactacacaatttctattcttttccaaatgtttaatagttttttaaaatgtagtttttcaaaagaatattttttcatagtttacattttctgtattctatgcctttgaacttttatacatgctagatattaagccaatagaagcatgtgtattttaaaataaattaatttattgtctgtttcttttgcctccattcagcagggctagaattgcataatattttctttaccaaagcctgtgaattaccacctgatgagtactgtgtgtctcatcagtaaggtagattaaccttgctaaagtaaagctcagttctctcatttgtaaaatgagtaaatagtgtataacacatagtgttcattttaagacataataatataatccacatgaaattctgagcacagacctaagattgaaataaaaccataaaaacaaaagagaaaaaaataaaaaagaaatggtgactactgctctctttaagcaaataagttggttccaatcacttcagccattttgctgtttacttgggagaaattatgtaaatgaaaataagtagatatttacatcttagagttatgggtggatgattactaagggatggtctagtgacttctctacataatttttaaggttgtctctaaaagggctgcctgttggcctggcagcttaatcatcaaagacataattaggtgtgaagacagccaaagataagccaaagataagtagaagggatgcatctctgtcactgggaagattggaaatagtacatgtcacaaacctggaagaaagttggccctgttacaaccatctctgaccttcttacttggtctgttctatgaatgacagatttatatgtagatatcaaaatagcatatgtttgagtgacaaagtagatctcaagaccaactcaagagggggcacaacttggactggttggtgaagggattcagagcaggatgaagtcaatgtacttaaataagtgcacagaaatggatcaaatcagtcagtataaagtgggatagcctgcagcttgacagtacattagaacagatgtaaaagtgcatttttttttaaagatcaacggtgattgtttagtcaggtacagtgtttgtattaaccaaagaacagccctgcctgcgtaactactctgaattggattacatgaaacctagccattaagtcttgatttgttatgcatgtgagcaggacagacagacagatgttgtgctaaaaaatgggtagttttcaaccaacaaatactttatctccaaaatacgaatgtcttctttgtacatcctattaattctaccatatatcaaacatatttatagggtgcctgctagctgttaaactttattttttttatttttttattttttaaatgggtcttggggctcagagatgataaaggtagggtccctgttctgaaggatttcaaggtcatgttagggtgttaaatttgtaaaaagacaattttaatataaaggagtgagtgcaatgattgaaacatctctagatgctcaggaagtgcaaagaggaaactccaggttcatccgtggagaatcagaacaagtttcagaaataaattttgagttttagagagagttaagagttaatgaagtcaaacagagggaggcatttaggcagagaggacaccatgagcaaaatcaaagtgtcatgcattatatacacacggaaaatgtttcttgtgtgaacataaaataagagataagtgataggttagaagcaagtatcttagacaatcttaaaaggccttgtaaatttagttaaaaatttggaaattatactctaggaataagaaatcattagaggttttcaagatgggctttgcattttagaaacagcattttggagatgaagatgtgagcaattcatttgaggaagaaaataccagtggccattatatcgatgcaggtgagagatggtaagaaacaaaaccctggtaggggaaatagaactgcataggaaagttctgacttaaaagagatttaggtgatataatctggaggaacttagtgatttattagatgttagggatgagagcaagacagaagtgtgcatgactctcagtttctagctttagggatcaattgatcacttctgtaattgcttactctgtatattctacatgcaacaagcttcatgggggcagggaatagatctacacatcccttgctatatttacaacattttgtataatttctagcacatatgaatgctctataaatgcttgttgaattaatgaataatagaagatgtgggaagatgagatggtttagaagggaggatgatgaattccatattgagcctgttaggttggaaattcttgtaaaacatgcagatggagataaccagcagatgtgtgtgtgtgtgcgtgcgcgcacgcgtgcatgcatgtgcgtacatgctcgtgtgtgtgtgaaatcagcagaccagcagagatgatcaggttggggattatggaaattccctgcctagtgagtagatgccttttacataggtggttctcttttttattgatgatcagctgagtgcatttcccggtcaatttattttttgcacttgattcatggctgaacagaaatactcctttagtatttgtgctaaatgacattttcaactatacggtatttgattcctgcaatttaaaaaatgcacagtctagggaataagcctgagttccagaggtttggacatgaattttaatttagctaggaaatctatagattaatcctgaaaaaaaagagagcaagagagagatactccaccaaataggtgaggaaaaacaagtcaaaatgtaaaataattgaattaggaaattgaccaagactaaagacttcatgttaaatgctaatttgagatatttgagaccgtagcatcttggcaaaaaacacccaacattaccaaatcctgaatttgaaacaatgaggctacagaatcaggtatgagctaaggctgaggtcaatatcaaagaattttcatcctcagtgctaactccacttaactgacagtggctgtaattgattactgatgtctggcatgggtatgggaaagggattgataatacttgagccaggtatttgccattattgatctagacaaaaagcatatgaatatgaataaaagaaaatgagccactgaaggtcaggaaccctaaaagtcatttgatgctggaattcacttcacaataaatatgccagggggacctccactgaagtcctctgaagatagacactctactcttaaaatactgatttcatttttgaaaatctctggctgttagaaatttctttgtaaaaattaaagtgaaagcaggcctcttttaactgctattcattgtctcaagttctacttttcaaggtgatataaagtaagcttaatatttaaaataaaataatatacacaagaatatgcctagagataatggaattatctgacttttccactcattagaaaaaatcaattatttaacctaagtgatgctatgttaactatgtaatcagatgccacagagtcttacctcctgcttcctagttggccaatgtcaatactttttgggaaatatttatttctatttttagacatgtctatttaaagcattcctggggcctccctcattttttaatttaagttttttttttaaccaatccacaaacatttatgtgggacttactatgtgttcagtattgggcttatactttaaagaaataccactgattgtttctgccttcatgaagcttttcctgtaccaggtagtgataccactgactcttcccttacatggggcatttctaatcaatggtctttctttacagaaaggaggttcctaacttataaggcctaagggagttgtcctcataaaaggccctgagaagttgtcctattcctatttatagtcaatctgttgatccaagggtatagccttgtttcttctcctgttcatttttctttaacacccacaaaaacttaaaatttctcttcaatgccacagtaacaagagctcttttaaaaatcatatcaaaatgctttatttacattagtagagaaatttccattacaaaacaaaaactaacatgatagattatttcaaaatagtattattagtattattatactttaagttctgggatagatgtgcagaatgtgcagttttgttacacaggtatacacttgccatagtggtttgctgcacccatcaactcgtcgtctacattaggtatttctcctaaagctatccgtaccccagccctgcaacccccaacaggctccagtgtctgatgttctcctccctgtatccacgtgttctcattgttcacctcccacttacgagtgaaaacatgtggtgttggttttctgttctcatgttagtttgctgagaatgatggtttccagcttgatccatgtctctgcaaaggacatgaactcatccttttttatggctgcatagtattctatggtgtatacgtgccacattttctttatccagtctatcattgatgggcatttgggttggttccaagtctttgctattgtgaacagtgctgcaataaacatatgtgtgcatgtgtctttatagtagaattcttttttttttttttttttgagacagagtttcgctcttgttgcccaggctggagtgcaatagcacgatctcggctcacagcaacctccgcctcctgggttcaagccattctcctgcctcagcctccagagtagctgggattacaggcatgcgccaccacgcctggctaattttgtatttttagtatagacggggtttctccatattggtcaggctggtctcgaactccggacctcaggtgatccgcccacctcggcctcccaaagtgctgggattacaggcgtgagccaccatgcccagccagtagaattctttataatcctttgcgtaatggaattgctgagtcaaatggtatttctgattctagatccttgaggaatcgccacgctgtcttccacaatggttgaactaatttacactcccaccaacagtataaaagctttcctatttctccacatcctctctagcatctgttgtttcctgactttttaatgatcaccattataactggtgtgagatggtatctcattgtggttttgatttgcatttctctagtgaccagtgatgatgagctttttttcatatgtttactagttgcataaatgtcttcttttgagaagtgtctgttcatatacttcacccacattttgatggggttgtttttgtcaatttaccttctttgtagattctagatattagccttttgccaaatggatagattgcaaacattttctcccattctgtacattgcctgttcactctgatgatggtttcttttgctgtgcagaagcactttagtttaattagatcccatttgtcaattttggcttttgtcgtgattgcttttggtgttttagtcgtgaagtctttgcccatgcctatgtcctgaatcatattgcctaggtatttttctagggtttttatggttttaggtcttacatttaagtctttaatctatcttgagttaatttttgtataaggtgtaaggaatggatccagttacagttttctgcatatggctagccagttttctcaacatcatttattaaatagggaacccttttcccattgcttgtttttgtcaggtttgtcaaagatcagatggttgtagacgtgtggggttatttatgaggccttgattctgttccattggtctatatatctgttttggtaccagcaccatgctgttctggttactggagccttgtagtgtagtttgaagtcaggtagcgtgatgcctccagctttgatctttttgcttaggattgtcatggctatacgggctcttttttggtgccatatgaaatttaaagtagtttttttctaattctttgaagaaagtcagcggtagcttgatgaggatagcattgaatctataaattactttgagcagtgtggccattttcatgatactgattcttcctatccatgagcatggaatgtttttccatttgtttgtgtcctcttttatttctttgagcagtgatttgtagttctccttgaagaggtccttcacatcccttgtaagttggattcctaggtattttattctatttgtagcaattttgaatgggacttcactcatgattttgctattttgtctattattgtgcttgtgatctttgcacattgattttgtatcctgagacttttctgaagttgcttatcagcttaaggagatttggggctgagatgatggtgttttctaaatatacaatcatgtcatcctcaagcagagacaatttgacttcctctcttcctatttggatgccatttatttatttatcttgcctgattgccctggccagaacttccaatactatgttgaataggagaggtgagacaaggcatccttgtgttgtgccagttttcaaaggaatgcttccagcttttgcccattcagcatgatgttggctgtgggtttgtcaaaaatagctcttattattttgagatatgttacttcaatacctagtttattgagagtttttagcatgaatgggtgttgaattttatccaaggccttttctacatctattgagataatcatgtggtttttgtcactggttctgtttatgtgatggattacgtttattgatttgcatatgttgaaccagccttgcatccaagggatgaggccaatggatcatggtggataagctttttgtgtgctgctggatttggtttgccagtattttattgaggattttcgcatcgatatttatcagggatattggcctgaaattttctttttttactgtgtctctgacaggtttgggtatcaggatgattctggcctcataaaatgagttagggaggattacctctttttctactgcttggaatagtttcagaaggattggtaccagctcctctttgtacctctggtaaaattcggctgtgaatccatttgttcctgggtctttttttggttggtaggctattaattactgcctcaatttcagaacttgtttttggtctattcagggatttgacttcttcctggtttagtcttgggagggtgtatgtgtccaggaatttatccatttcttctagattttctagttgatttgcatagaggtgtttacaatattcacaaagtgatggtggtctgtatttctctgggatcagtgatgatatccccgttattgttttttattgtgtccaattgattcttctctcttttattctttattttctggctagtggtctatctattttgttagtcttttcaaaaaaaaaacagctctgggattcactaattttttgaagggcttttcatgtctctatctccatcagttctgcttagatattagttatttcttgtcttctgctagcttttgaatttgtttgctcttgcttctctaattcttttcattgtgatgttagggtgtcgattttagatctttcctgctttctcctgtgggcatttagtgctataaatttccctctcgatactgctttagctgtgtcccagagattctggtacgttgtgtctttgttcttattggtttcaaagaacttatttatttctgccttaattttgttatttacccagtagtcattcaggagcaggatgttccatttccatgtagttgtgtggttttgagtgagtttcttaatcctgagttctaatttgattgcactgtgctctgagagaccgtttgttatgatttccattcttttgcatttgctgaggagtgttttactttgaattatgtggtcaattttagattaagtgcaatgtggtgccaagaagaatgtatattccgttgatttggggtgaagagttctgtagatgtctattaggtccacttggtccagagcttagttcaagacttgaatatccttgttaattttctgtcttgttgatttgtcttatattgacagtggggtgttaaagtctaccactattattgtgtgggagtctaagtctctttcaaggtcgctaaatacttgctttatgaatctgggtgctcctgtattaggtgcatatatgtttaggatagttagctcttcttgttgcattgatccctttaccattatgtaatgcccttctttgtcttttttgatctttgttgatttaaagtctgttttatcagagattaggattgcaacccgtgcttttttttgcttccatttgctgggtaaatattcctccatccctttattttgagcctatgtgtgtcctttcacatcagatgagtctcctgaatatagcacactgatgggtcttgactctatccaatttgccagtctgtgtcttttaattggggcatttagcctatttacatttaagatcaatattgttacgtgtgaatttgatcctgtcattatgatgctagctggttcttttgcctgttagttgatgcagtttcttcatagtgtcgatggtctttacaatttggtatgtttttgcagtggctggtactggtttttcctttccacattgaatgcttccttcaggagctcttgtaaggcgggcctggtggtgacaaaatctcccagcatttgcttgtctttaaaggattttatttctcctttgcttttgaagcttagtttgactggatatgaaattctgggttgaaaattcttttctttcagaatgttgaacattggcccccactctcttctggcttgcagggttcctgagaaagatcttctgttagtctgatgggcttccctttgtgggtaacctgacctttctctctggctgcccttaacattttttccttcgtttcaaccttggtgaatctgacaattatgtgtcctggagttgctcttctcaaggagtatctttgtggtgttctctatagttcttgaatttaaatgttggcctgtcttgctaggttggggaagttcttttgggtaatatcctgaaaagtgttgtccaacttggttctattctccccttcactttcaggtacaccaatcaaatgtagatttggtcttttcacatagtcgtatatttcttggaggctttgttcattccttttcattctttttttctctaaccttcttcacgctttatttcattaagttgatcttcaatctctgatatcctttcttctgcttgattgattcagctattgatacttgtgtatgcttcacaaagttctcatgctgtgtttttcaactccatcaggtcatttatgttcttctctaaactggttattctagttagcaattcttctagccttttttcaatgttcctagcttccttgcattgggttaaaacatgctcctttagctcggaggagtttgttattaaccaccttgtcaagcctacttctgatttgtccctgaggctatgatttgcacaactgtttttaattttaacagatctccaaagattaagaggcctatattaacacaagaaaatgacagaaagagcttttttaagattgtcccatttattagtgatggaaaagtattgggttttatctataatctttaggtctttttcatataaaaataattacattccaaacatgtttttttggtaagtatgatagattgaaaataatctagacagttctaaagtactttattgaatgcaaatttatgaaacaaaacagcattaagttaaaaagaacaactttatttacagaaggctgatctaaggtaatcattcagttgataagtttttttaaatgtttacttaagaaaatgatcagggaaaattttaaataataataacaaaatataacactaataaagtaaaagggactcaagaatcttcatttggacagagtgtagcagtgaacagaaaaaaaaaaaaaaacgaggtaaataggacccagatcataatttttcttattggcaacttaacgatgtttgaaagttaccctgtgggctcccaaaccctctccatctcccagtaaaaacaagagtccatattctagttgtgagactgatatttggctctgcctctgtcaatgtcatatggctgcaattcaagggtctaggcgtagaaaaacagtatttaagcaccataagaaaattcttaaagttcactcaccttccttctcctcttcctccttctctgccttccttagtcaattcatattttttcaaaaaacattgtcatttaaatgtcatatggtagtctttggttctttagggccacacacacatattgtggctttctctctctcatactctggttgtaattagggatgataatttgaatttatttgaccgatgaatttgaacacaagtgatgtatgtattacttttgggctggagtatcagctgaagttagaccttccagaatgctcttttccctctgccacagcaacatcaagtttctttttcagtctgtgtagtgaacacatacaatgaggacacacaggggcatctccagatgatgacattgcatatgcaacatgaatgagaggaaaacaaaatgaaacaaaaaccttgcttgctttattcaagtgagaagttggagtttattggtatgcagtcataacataaaagtcctggcagatacaattgtgtgtattagaacctatttcattagagaagataatcaagtgtgaagaatgcttaagaagactagtgaggaatggagtctccctcccactcccagctctccactcagaaaattgagagttgtggacttggaagggaaactgaataagagcttttgatccgcagtggtgttagttgcagatgaagggagaatggagagaagaacagttatgtttgaacctggaggaattgtgtaaacagttaagaagggagcttcagcaatttggtggcatcaggcctagtccactgggctggaaaaactcttacttgtttgggagtcatgagattatattgtttctgggcactaaagctaaaagaaatggaaaaaaggtttcaacagctgtaatgatagaaaattcccctaagtcattgttttttacttggggaagtttttttataacaaaaatccagactgtttcatgtcagtgcggtggtggtgggaagtcagcttttactacacaaacccctgctccaccacaaacactggagttaattttaagaaaggaagaaaattgtgtattaaaaattaattaagaacactttttgagtaaagtaactgatttcaacaaagggtaaaagagtattatggatttatggttaaagttgtttctgagtgcttgggtcatgtgttatgaatgaatctgcctccaacagagatcaaggcaatagaggggatttaacaagccatttggataaagcactgaatctcctcaagtatggcagattaatttcaataattacccaacatattttaaaaatgactttaaaaggcagaaccagtttaatgtagtggaaataacactggagagggcttcagaaagtttatgtttgtcctagatctacctcagatttgcaatgtgaatttaagcatgtcactaaacctcatcaatactcagtttcccaaagtataaaatgagtgggttgaacccagagactctctgagatacttagagattttgaatgccatgattctctgaccctctgatttagggttgatttcccagtctgttgttaaccagcttgaacaagttgtttaatatttctgggcttcatctgccttgtgagactaataatagcttacctacgtgaaggaaggagctggaacacattatctctcaaagtcccttctggccctatgtattttttttatgaaataaatattttgtgagttcattattacatctgttaatgtgcctacaagtagtgttgatagaagccatatgaattttgggagaatggaagggtggggaagtaggaaagagaatagaagaaagtggagtaaaaaaagataagtaaagatgagatgaaggagagatgaaagtaatgagtggagccaagaggaagaacaggcactgacctttgttttgtctatcatttaagatgttttcagttacaaagaaaaacaacagttaaaacacaggcatctaaaataaaactggttaaaaataaaaggagtttattgccttgtgattcttacaagtacagaaatacaggagctttaggcatagtttgaacgagaagttcataatgtcattagagctctaatttcttttctctgaaattctcttggttttgccttcctccatgaattgacttgattttcacactggcttctctcatagaggcaaaattgactatagaagtttcaggcttcatatacaaacgttacgctatccaccggaagaaagagtacttttgtccctcaatccaaggaaagtggattcactgaccagcttgggtcacatttgtacccctgaaccagtccctgtggtctgcagagttaaagtcatggggtattttcccttagactaggtcacattctccatccctggagctaagatagaatcaatttccttggaaccctatggatctccaaacaggaaatggaagatgttgggaaggaaaaggagaaaatagaaacggaaagaaaactaaaatttcacaatgacaccttgaaagggtggctgtgtatgggacctagaatcaatagccttgggcctggctaatacctctttcactctgtgaactgcgcaagactcagataccttcttaaaatgggagcaacagaatgaagtttctacaaagataggaactttgttttgctcactagtattaatatatcctcggtgtccagaacattgacatgcacaaagtaagccctgaataaacatgatttaaatgaatgaatagtactaacctcctgaagtttttataagatttaaagtggataatgcatatgaagcacttggcacagtgcctgacagagtaagctcccaagaaatggtagccagcagcaagcagcagcaggagttagtaatagcagaaacaatagtagttgagcaagaaatgtattagaagggtttctttatactgtaaaaaaatgtgaaaaatatagaaaagacataagattcaaaaaatgcagataaagtttccattatagagatgaagatttaatcaaataaagcctttttagaaaagtctatatttttactgagttttaaaataatacatgtgtgtcagaaagaaatgataagtacagactagcactgatgaaaagcagttcgggctcacacatagagtagtagatgaggcagctgggagttcttacaggagaggaaagagtagtagctgacatttgaatattaactatgcacccaacactggtctaagaccttaagtataataaatcatttaatcttcacataactttatgtcatagtactattacttttcccattatacagatgaggaaactgagatgcagaaagatcctgtgacttggccaagtttactcagtaggaaactggtagcgcctaggctcaaactggggctattttcacagcttgctcttaagtactgggccctgctttatctctattatatgggctagtcctgaggagctgtgtctctctaaggtacttacattttttgtttatgaaacaatggctagtctttggaagttttagaaaagagaaaatagcgagatcttatcagtgtaaatatatctttaatgttcattagcattcctttttttggtttatatgtttttaattaatcaagcagtagttattgtttataagtgatacatattgcaaatatcacgttaactcactctcttcatcttccttaataggttttctcaaactttccctaatctgcttatcacttcttcctttcccttttctcacatagcttgctacttctaatctcctgagatggagaaatattcagataaatattacgtgttaaatcatatttgctaaggttctcagtgagtgatgaggaatgtaaatataagatttcacactagagtagcctcttttctttttatctctgaagtctgcatgatgatcttgagatctccaagacagtagaaaataaggcatttctctcacctaaacctgccaagagagcatttgtattaacctgtaatagttaaagagggtctcctatccatgcattttgaataaatccccaaaatattagtgatatggacaggaggcatggaaatactgactagaaaagggcagtccccagtgagggccacaccctgaagcctgggactgtggcccaaagtgagaacatgcattactattttcctgctcaaatgttgtttttggcccacccgcccccccaatcctgtacccataagaaccccagtctcccctggcagaggggtggcagagaagcagagcagctgagtggcagagcagagcaacagagaaggagagaagagaagaagcaactggacatcagagagaagcagcttgacttcagagggacggcttgatagcaggactttggagaacagtttggctaaggatggccaaactccaggtaaagatcatcttcccactccagcccctttctagctccccaccccactgagagccacttccactgctcaataaaatcctccacattcaccacccttccattcattcctgtgacctgattcttcctagatgctggacaagaacttgggtaccaagagggcagctgcattccttttttataaattaaaaaaacatagtttattctcctcacagaagataggtgggtaacatgaacccaatacatgaacacagcgattgatagttgacaatgacacaaaagtaacaatctttcacaaaacatggaacacatagagagtcacagtcaagaatacaagaatctccacatcatcacattttcagccaatatattatatattaggagactttcatgtcttttatgtctaagcttcacctgtgtgagaaatactgtagcagagtaaagaagtctttagctttcaggagtgacttgccaactgttttttttttttaacttcttggtctgcagactgtctgttctctgccactctcactgtagcacctgttggtcaagacaatttggaggagaggtgaataacttgattaattcagcttatatatcctcaaatcgacaaattgtggtggtgtggaaagaacaagggtttgaaaagtagatagtttaaattccagctctatcacttctcatggtgttagtacaagggtcagtgcaataaattctgaagatcatcctaacatttcctcctttcatccctctagcccttgttttaaacaagttttaattaaaggagatctcatcaaactgtatgatcttgaatcaaaaggaaaacatagatgcttttcttcttggccaaggccagctttgggtggaagtgttgtaacttctgttgacaacataaggggatgtgttgcctttttgaaaaaatgggttgcttctttggggcaatggcttgacttggtgcattggggtctaagatcttgcatggagaaagtgattataagggactataagtattaacatggcaatttcctctaacgcaggatatcactgcctgacaagtgactctaaccaagggctcattagagatagacaaactgattttgaaaagcaagcagcttcattttcagaccttcagccaaactataacagcaaaagttctgaatgagtctagctgaaatgtgaatggtttaagttttaccaattatctggtctgtctccacgaatgattttggataacaatatcgtaagatactagtgagctgatcttcctgcaacaatcataatcagcccaaagctgagcatcatcatctcaaacacctcacactgtctggcacataggatgtacttggtaaaaatacttaccaataatcaaatgaatgagtgaaggaacgaattgcttgtttgatttatatgtcagaaactttggagtgaaaagagctggatgtgaaaaaagttgtgggagttggagcagattccttaattcttgccttaggtttttatttcatcttccatatcaagtggatcacagagccctaacattcttttttatctaaatgctttctattttcccctaaattttggaccccatgatctcttgcctaacattcctgacttgttttcctttacttaagtctttctgtagccacgctccccagggccactgagtgatatgatcatgtcacttccctagtttaaaacctttcaagtgcacccaagaaggcagaaagaccctgttggtgtatccaagtacaaagaggactgcttttcacaaaacattgcttcttctcagtagccaccccaccttatcagctgactcttgtgcactggcacaggaagggagcaccccactccactctaccccactccacactccgtttttcccaccgctgtgccaggtatgggcaccagctccctctcaacctacatcatcacagtcctatcagctaaaagggaaatgcaactgtcatttctaattttcctcagaagctttgcaaaaggaacagaactgaggtgactggttctactttacattttgcttccagcaaaataatatgctctgatttttaagcatcaagggcccagcaagcccccaaatgcattttcccaggtacattccccccacaatttttctaacctcttactatcatggggaaatttaatccatatgtttctggttcatttacacttaacttatcaaaatgttctgctgtaagagagatttgatgtcaaagaagccttgtgggtctcatttatacacgtcttttctttgaaccaggaagttaaggtttgccagaaaaagcagaaataaatgctgtaaagagtcctttttttctaaaatgaaactttagaacttcttacaatgtgagaacttctcaacccaaaataccagggttttattgcttagacatcagtgtgccctctaatcctttttcctttctctccttaccccctaccagacagtgtgccaccattcttaaagaaatatttgagaaacaaaaagttaattgaagaaatgggagtagcacaggggacaaaaatagcgacgtgcaagtaattgactatggaaaactctatgtcattcaggataaatacattttcttccaatttcctgagctaatggtgatgagtgcaccatcatgtgacttacgctgcagatctccattaagtctcttatatttgagatacctttgttggtcaccctagattagtgctgttcaatggaatattcaatgctgatggaaactatgacatccaataccgtagccatttacacctctagagtgcttgaaatgtgactactgtgattgagaaactgaatttataattttgctcactttttttttgtttgttttttgagacggagtctccctctgtcacccaggctggagtgcaatggcacaatctcggctcactgcaagctccgcctcccaggttcatgccattctcctgcctcagcctcccgagtagctgggactacaggtgcccgccatgatacccgctaatttttctttgtatttttagtagagacagggtttcaccatgttagccaggatggtctcgatcacctgacctcgtgatctaccagcctcggcctcccaaagtgctgggattacaggtgtgagccactgtgcctggccaattttgcttacttttaactaaattaagtttaaatttaaatagccacatttggctagggtctaccacattggacagtgcaactctagatgcctatgggatgaaagagtcataacatcctgtatttagctaactcttaaaaagcatgtggacctttataatgcagcataatgcattcttgatattaaaaagttagccaataggactttcttaataagggtgggaaaacctaagtgaatcaaagtacatatcaaactccaatagcagaaaccaattcaaagtttcagtaatctttgtttaataatattctcttagaaaacattcctacctattatataaaaacgcaattatacccttgaagtttcatggctaaaatgactggacttaaaagaaagtatgcttctttgggagttaccattcctgggatggcctgtattgtagttttatgcctcattccagtaatcattttcaatgtgttaattagacaaataaataaacccttgctaggcatgtgaacttcactttcagatatgatagccaatattcccacagatgcttgaagatagcacaaaaggttctgaccctttctaatagctaaaagaatgccatgtcttaaaaataacctaaggggctgggcgcggtggctcacatctgtaatcctagcactttgggaggctaaggcgggtggatcacctgaggtcaggagtttgagaccagcctgcccaacatggtgaaaccctgtctctactaaaaagacacaaaattagctgggtgtggtggcgggtgcctgtaatcccagctatttgggaggctgaggcaggagaatcacttgaatctgggaggcagaggttgcagtgaggaaagatcatgccattgcactgcatcctgggcaacagagtgagactccgtctaaaaaaaaaaaaaaaaaaaaaccctaaggtctgtactaagaagccccaatgccccaacctttaaaaatctgaagctaaaaagagacagaacaatgagtcaaaatactattggtctattttagatagagatacttttcttaaaggactacatgcaaaaaaaaaaaaatagagatattgttgtgactactggtaagagtgagagctgaaacataactatatagtttttcaacttcaaatagatttttacatcaatcactaagaatcaagaactatggggtgattcagtctcccacagggaacatctcacattccatctcaaaaattagcctgcccttctccctgcacattataggaatggccaagtcatagaaaaggtgctgactttttttgccagtaaatatttggaaaaatctcaaaattatttagtaaaaaagcaaaggttatttgagaaatgcttttaaatattgaaggaaaattacaattatccctgagtcattggggttcatgagtcacctgcccctatctcccaattaattaactaattaatgaattaactatttcttgagctcttgtcctctgcaaagcatatgataaaagtagcttttgttgaatatctccacatcttatttactcattcatctattaattcattagcactttcaagccttgtgttctgctatgctaagccaaagaagtactaaagggtagtctgggacttgatcattagtcccactaaattaaaaaccttggagtgctcactttcaatgtcactacctggttatgtcactcagcgactttttaacatatgcctgagaaatccttcctgtcagttaccacatttcagttttcatttctttatcagtcagcaatggctgtggaaggataaggatcagatcaccacaacactgagctgtgctgcctcactttctccctggagggtcactattaggaagcctgtaaatgaaaaaatatttcaaataggtcatattttgtactccacatacactttgttgcacatctttcaaatgctatttccccaaaacactggtgaatctgaaagttctttgaaatgacaccagaaaataatagcgaatatttcctatagatttccacttattgctaagaaggctttaattgtttttgttcctattttgtctatgtctttaggtactagatttcagacaggtcaagtctactatttggatgtgagcatgtattcattaattactatgtgccagacactattctaagtgtttcacctgtgtttttcttaaactattctcacaaaatatctaagaagtaggtacattttattgttctcattttgtgaaaagggaaactgaaacttagagaggttcattggcccaaacttatacagaatgtaattaaaggagccaaggtgtggccaccatgcttttagtcgcagtgtaacccaaactcacgtttttgatctttcctggatcttgctataggttaggtgcaacacaaagtcttcctagtagaaaattattattatatatgcattttcatataacacatctggataagtcacttccaggaaacttgtatttctagaaaaaatactagagttatattaaagtgtaataaaaatttttatgtatagtaatataatcaaaattccaatatgcatacttttggagaactgtaggtgaaatgatcagtatagagctcttgtcttgttataatgttgaggcagagacatatattaaggattaatatattactaataaccataaaagaaggtaggcattgataaaatgattaaaaacaactaatatttactcagtgcttactatatgctctatatggtactttgccaccattgtctctcaggaacatagaataactcactcaaggccatgcatttatagtggcaatggtaggacttcaacccagttctgattagcttagagtacacactggcaacattctactgcatcactttcagaatacacatggtaaaaattaataagaggtcaagaactatagaaatgtgacagttgctgggctgtgaacctatgtacctcattccccaagtaatacccaagtttatacttcaattttaatttgcatgtaccctcttcatatgaggatgtctcagcagaattcatcacccaactagagtccaaaatcactgttcctacatggaaaaagagtaaaaattatgtagctatagagtgagtttctgactcagcaaagaataaatatctgtttgacagaccttaacttttttatagcagtggaaaatgacactggagagaaaaagaggcttaaggagagtaggagaaagttcagtctgatttagcatcaccatttgtattctctgtaaagatcttaaggcatgagccacacatcagaaggtccaagggttctcattgtctatggcttgaagtttattgctgttgccaagaaccaactggcatcagtaaccgttacctccaaaactctgacggaaagtgtgtactaagggacattcatccattcagcaggaccataattttatgaaaggtagttagcattggcaggtgagccataatatatctgacctttaactgtgattcagacagcaggtagaaaaaccactggatgatatatctcctgccaagagattgtccataaaatacagcacacttccctgggcaatcgcagatggataaaatagtgtgccatttagatcatccctgtgcctgtgggttggattaaaatgaaaagctttggtaaccttcccacgcaaaaaacttttgctctttgagcatcctgatatgtcagcacctgtattaatgccacagctgcagactgaaactgctaatttccctgaagaggagaaggcagcattcaatagaaacagcttgtccaaagccccagatgaaatgggccaagtttaatgatccaaagagagtgactgatttgtttcttaccataacaaaggcaaagggatcttttacaacttgtggctctgtgccctcaatcatcacagttacacatctctataagagggttcataatttcaaaaggtggactgtatttcttcatcaggattttcttggccatatgctatgtgcagggtctgatgatataaagacaaataatactacttatatccagccatttacaggttcacaagcaagaagtgaaatgtttatattagggagttatgcacttaattttcagattctgtgtagcctattggggagcctgtaaagagtacataatcaattcttcctggatgtggggcaggaaaatcctcacggaagatctcttctgtgaagtcttgtaaaatgtgtaagggattaccaagtagaaaagtgagatacaaaagtcattccagcagaggaagctgcaccagcaaggacaggaatatactgtatcaaaagctgtcagccgttggtttggccacagatagccagtgacctgaaggaggtgagataatgctgacagtaggctggggtcagaccatgcagaggtaacagtaataattgcaaacttggtttcacagggcagctgaatgaaattatagataactggcctcattctaggagattatgatttactaagtctgagatgggacagagaacctgtattttcaacatcccccacaatcaccaccaacaactaatactgatacagccagtctttgaagagttttaacaaagaaaaaaacatggtctaatctatactttagaaaatcattccaggaagagactggaacaggaatctgaagggctaaggaccaaagccaaggagatcctccactctttagagattagaaattgatgctcagtgatgttacatgactttccaaatctgtatagctggtaacagaggcagaatttgaaaccatatttttataactgagaagtctgggattttcccattctactacaatgtcccttaccctactgctgcaaggatactgtctaagataactaagtcttagtgcaaggggctggaagcaaaggaaatcaactctggccagttgaagcatctgagataagagcacaggaaattccaggtcatagacatacactgattgaaactatgtgctctggctgattagaattcaattctctgaccctcctgtaattccactgcagtttaattaaaactcattaaactgacatcacattccagcagataattagaaaaatagtacacactttaagtacatcgtcttattctggctacatttaatgtaaaagatgaatcacacaaacaatggttactagtagaaattaccaataattttgccttttactgccctaggctctcattttgcatgatcttgtataattatcacaacaaccttatgaagtatgtaagataggcccagagaggcttagtactttgctcaagaccacatagcaccagtaggaagtaccctttgtctacatgattttaaagccttttgtgtctctgttttttcactaccatttcatttttttcaacagtctacattgtgagtattacctacctagcctagcacccttcctctggtgaaacagtcatgaacacaatgggaccagtgggatgaagctgtttcctatatcaagattttaagatcaccagtgaaaagaatgaagaaatctattgtaaactggattacctagaaagcagtctctgggaaagggagcaggtgcaggaaggcattagaactacttgggatcaatacctgtacagaaatggaagaaaaccagattagctagaggagaagttcagtttgtaatcaactttggggaactctgacattgaatggcccttttgagcaggggcgatataccctgtccccatcaactactcgttggatgcaggctggcactgggaagaagcaaaaccctcgtcaaggcagctgtcttcagccaagagaggttgacagtatttggaggaagtctttctgtactgaagtgcagtctgggaggctgaacataccgtccaccatgaggtgtatgtcttcttggtactatgttctctcttctctcttttgatctgctacagtcggggctcctttggcttgggagggattttcagtcatccagggctgagaaagggcttccagtagtggaacactggccacgtcttcatggatgatacaagctgaggacctgaaggaagagcactgactaagccacttttctgtttcacctgtgaatataaatatgagaagtgtagtatctctagtctcatccatgtggtttaatcacctttcatttatcctttcatttatttattaacaagctacatattttcataggcagtcactctgactcataaatacaaatacaaagagcaataaaatatcaagcctttagaactttagttgcctgatgctgggtgtggtgaggagtgagcaggagtaagtagtgaaccactgttggtgcatcaaagaggctaacaactttcagaggcatttgcattgtttagttccctagattgatgggtaagagaattttctaaaagaactgagatcaaaagtaaccttccccatttaagtcacagagataggccacagcattccacagttatgagggtaggttgattggggtgagaggagatgaaaatatctagaatgcaatgaggttgtatcccatctggaaggaagaaccactgaaattaggaacaagacaacggtcatcatagagttgaatctgaagcttctttttaagagtagagggctgccccacagcagaagttggatttgcaagcaagatacacaaatgttttagaatttgaagctgtagagtctctgtcactttgatgattactcagtgactgtgagtgccagactaacgtaatctgtagcttttatatttgtcacacattgaggcagttttctgtattattttcctaaatactaattgtgaaggaagggcagtagcacataccacctgtcatctataacacatgtatccctaaggagcatgtggagagggaaaagggataaaaccatcctaaaccaattgcataaaggtcttcattggaagaatttaccttccttacaatccaggagataagaccagttttgcttggctaaactgataatttatataattaaaatgataacttctccaaaatcaaaggagtcaaaaagattcaccattggcgccagctgcattcaatccctttccccaacaaatatttattgaacatgtattatggccatgtcctgggaattatacagtgaccaaatcagagagcctcctgctaaggactttcattctagtaacttctcggcccaagcagagtagcagaaggcaaccagtgatacctcatcctgggtatggtttagaagagcatggggacaatatatttgtcatgtttaacttgggttatagggtaattcaggagtgagaactgatgttgcttgattttccacccctggtattcaagagtcagacacacagaagttattcaataaatacttggtgaatgaacaaatagcccggagcgatctgtgtgtatttttgtcaggatggctctctgtgataccaaacagcatacaacttttcatgagatttggccataaggggatgttgtgtcagtgtacagagcttcctggaaggaaaataacctgagctatttaagcaaagggcttatcttttcataaaggtccctatacttagggtcttctacatcccagtgaccttattctcaaagacaaacacagaagaccctttgggatagaaggtacacattcagaagcgagtcaatgcccttcaaaacaaaagtatcattttcttcagtcattccaactctattgattatctgctatgtgccatgcatggtgcagggcaccgaacagtacaatagtgatgacggcaatttgcctttaaggagctcacaaactagtgacagagaaataatcataatagctaacatttactgagtgcctagcatttgtacttccttaaatctataaggaaccctatcagataaatggtattatctatatcttttactggtaaagaacttcaggtagcttggataatttgctcaaggtcacacaaaattatttctacatggcagaccctgcattacaatttatatgtatctaacaccataatgcatcctcttaacaagtatcatacagcctctcactaataatttgacagatacttgacacatgcttttcacggtcattaaagccaagttgtcaagagccagattgcctgggttcaagccttgaccccactattaaacaacatatttaatgtgtgtctctgttgctttacctattaatatgcataataataatagtaccttcctcagagtgtttttatgatattgggagttaaattagatgctcaaaatgtatagatgctcacttagtaagtgttacataaatgctacccctgatccttaggcaatgatttttctttcctctgaaactggttttgttgaatgttctaatgggggtgggaactcataaaaaccagaaaagggagggtggtttttctcgtgcacatttagtggactgaatttttaactttcctaaatctgaaagtagcatcagattcatgcagattcatgttatactcacgcatagaggcagtcagagaagaggcagattgaatgctgtccccactattttatgttttagattgggctttctcatctgagaaccatgtacagacaaacgttcccattaaatcctctcctcctttatttttctctttcagtaacatgggtacaaaaagctaacagcatacccagggaaaacgcatactttcagagcaaaggtcaaagtttattaagcacttcaccagctcaagtgtttttacagaaaaccaaggaacattcaattcacaccagggcttttaagttcccggaaatatcatatcatatttaaaggattctaatttagcttatttatagagtgttgatcaagacaactttttaaatattctagacctttgatacacagagtttttgcccctctgtgggactaaacgataaaaataaaaaacctaaagcaggtaccaggaaaacaaataaatatctttcaggaagctgagtagagacttttatgtgtaggcagaaatagcagaatctttagaaccttcaggccatagaaattaaacccttcatcatgaatgtcctgacagaagaaaaatgtgtctgagtgcataccatgcactgatgtgtacctgtttgtatgtgcacacacatgtgtgtttatatgtgcacatgtatgcgtatatgtatgtgcagtcatgcacacatctgtgtatacatccatatactggtgtcagacttggtcagagagtcctctgtttatctgaaaaacagagaggagccaaattgcacaagaatgcttgtgagtcatgaggtcaccagagaatctggagtagtgaattaaatgggacttcttggagcaataccatacctcctaccattcactgggcattaactaggctatgttcattataagtaaatgactcaaaatcctctctaaggccctatgaaatagcccttaatttccccattttacagagaagaaacatgagtctcagaaaggttgaagatgggatttgaacctaggatttagtggctccaaggcctcactctttctataaaactcaattgatgggggaagtctctgtttcctcaacaattacatcacttgtggtgcctggaaatcctctggcaatggactttcacaggtttaagatgttggggagaaaaaaagtttttaaaaattagacatattatatctgatgagcaacagctaaaaacttaaaggtggacacaataatcaaacatatcttgaagtcagaggatttttccaaagggctgttataatacacctatgatctacaacttaccttgagcactaccctccaattacccagtatggtatttctatatatttttttaaatataacttcactatttcttatctcttatccaaagtgctgaataaatatttgttgaatgaatgttgaataaaggtagaaaaaaataattcaagggtcatggaatagcctcatgaattttacagttttatttcattgatctttctgaaaacactctcataaagacaacataaatgccattgtattcagatgaataaaatttggtgttccatgaagaaacaaggccatggaccctaggacattataatttgtgctctctcaatgggatcctgaggataggggcttaatgaatgttgtattaattatggtaatgctagctgctataatcaatacatcgcaaatttcaatggcctaacacaataaaatttattcctcactcatatgagagtccaacacttctcttcccttttggcatgcagtttttctctttgtagaaattcagggactcagttcccacagtcttgcagctctgccatcccaaaggacttttgagccagttaaggtgaaagagagagaacaaagatacacccgcttcttttaaaccctggccctgggtaatacactttcattcacatttcaccagagagttcatggttagttcataaccagtttgcaaataacaactccacactactgagggggaaatactactttctagtagactctgccattcatacattccccagatatgcctagactcccaaaggaaatggcatttatggcttattataggattataggcactgtcttagattcttctcatatattatcttactaatctttccaaaagctctatttagcattatcctgactatcagaaaaagaaactgagcctcaaataaatgatatgacttgcccgagatgattacctggttaatgacagaacatggatttaaatctggcacgagctgattccaaagcccatcctctctccaccaaaccaaagaaggattcacattttcaaggatttgcgtgtttcttcaaaagaatctgagtagtagctaaattgttgtttcacattattgcattagactaaactttacactgtattggacagcttttactcttgattaataatgaatggctagggaggatgttcaaattacttatagacaaaacaactttatcagcacatctgagttaaacaagttaatcttcgtcagactgtcaaaagacagtctgaacaacaaaattctagaaaggacaggaatgcaagtgtgtttcggggcaactgaaattagagaggcagatgcttcttaaaatgtctctatattcatctatacttatttcttctctgtacttctttctatatatcaactttagtcacttctactaaagaatggcttactcatatgattcaatttatataaaatgtttagaataggccaaatcacaaagacagagagtaaattggtagttgtcctagcctagggggagggaggaaaggaaagggcctgctaatgggtacagggtttccttttggggtgatgaaaatgctctggaatttctgataaaagttatacaactctgaatatagtaaaaccactgaattatactccttaaaagggtgaactttataccatacgaattacatctcaacaaagctagtatttaaaaaaaagaatggttttcttcccaggttgaggcaaatggcctctaggaaattctaagtgtcatatattgtgggtgtctccaccagcgactgactagttcccagattcaggtcaaacaaacagaaaaaaatatgcatccaaaggggaaaaaacctgttacttcgccagtcagcttctggcaagggggcatgatcacattaaacagacttgggaatggagtctcacttctgtgaatgggacgactctaaacaaatgggaaaaatcattgcagaccaatcagctacagaagggttatctaatctaccagacttcactacagattatatatgtttatatatacccaatatgttatgccatagccttatacaccaaattttagggaatcagcaaaatatggaagctgcatgagcactggactcagacacaccagttttgtaatcccgccactgactaagtctatgtcatcggtgaggtcacatcaattcacaaggcacccaattttatttctgtaaatgcaataaaaatatatctatcacttgatcatagtaagtaaaaggatgatataatatatgcaaagcactcagcacagaggctatccacatagcctatgcctatacatagcaggtgcctcataaatattaatgagggaatggtacaagcaattggtaaaaacaatggagaagcaattggtatagccagttccaaaatagtgatcacacatggatactccaccaagaggaaaaatgaatggtcaaaggagctggcttttctattttgtcattctgaccagttgattaattaagatagacttacagtcactgctgcttgcaaggtccagagcagaccactgtaagggtgttataaataataccagtaatatttcacaatttcacatttttctaagtatttttatgtctgctctctgttttgctaatctttccccatctagaaaaatcctgtttatgcttcaagactcagcctatgtgtcatcacctttctgaggcctttggtgacattgccaccatcccaggaagaattaaccatcctttctcctgtatttctattgtgatatagtcacacttcttgcgtagtattttacacatcagcatattttacacaccatccctcatcagattataactactacaacagtagtccagaatccagcatagccttctgcaaatgatgaatgtcaaacactctttgttgaatgtagcaataaaactacacataaaggaacagtgcctggcactggctaatagcaccttatggacaaagtaaagttaaattaaatttggtgatcagaaaggacatatgaattacctagaatgggaaatttatttttatttttaccaaaaaataaaagagagagagactaaatgacttgcccaaagaaatatgttaagaaaatggtaaagctgaattcagcaagaaaacgttccttgtgatttctaacttagtgccttttgcatttcactgtgttgcctctgaaattttttaaaaataaaaaaaggctcaacaataaaatgaaaatttagaatcagattaatagctgatgaatatggcttcttccttgtgacagttatcaacaaatgaactcaaccatcttatttttaaaattttcactgttttcatagcctttgcctgtttgagcttctctacctcaagagcttttggaacatgttaggaaaagatgggtattccttgtataaaacctcatgactttgggggagaaaggctgccctggattcatactggccattaggtggaggctgcgacttgactgatgtgcacagctaagcaggataggccaagaactagaacccatatctccattctcccatatcatcacttcctctgattgatgtgcaatgatagccatcatcaactgacagacgtacatgtataacagcattgtttttgtatgtaagaattaaagaggaactaggtcaaaatgtaaatacaatttcaaatgcagtagaatcattttttacctcttgcctatatactttgtagaagtagttgtattgatcttgtgacagtctgtttcaagctaaaggccccaagttttgatcaggttcacagacgctctttaatctgtagatctatgaactaatcaagagttcaaatcccaacaattggccaaaactctaatattttgaaaaatgcttttctgttcctgacattcattttccatcataaaactaacatttttaacttgggatttttttaaaaagttaaacagtctcaaagaaatggaaaacatttgggatttttttaaaaagttaaacagtctcaaagaaatggaaaacatttctcaccaataattatggtgtctcagtaattatcaccattccttcatgacaatgagaaactgaaaaacatttgaaaaatatgtcctgattttgctgatgactaatcagagaaaatgaaatataaatttttatagatactactatgtagcaggtatttcaacttaataatatcatttaatctccataccaccataaaatgaatacaattatacttattttatcaaagagaaacggaagctcatagaatataaatgagctcctcaacctcatacatccaaaaagttagagcccaaggtaatctctattgattctccagttgcaattttccagtatttttctagcagtgaactttatgaacagtaataattcatcaaattgtttgccctctcttatttactcattccttccacaaatgttcattgagttccttactacttgccagcaccatagggaatgacagtttttaaaagataaaaagtcaacatacaatgaaggggaaccttctgatgtgaatgtattccagatactgtcagaaatactaagggaaaactgtatcctagtccattccctcttaaaaattcatgccagaatattgattctgacagaccccatattatcattgttgacaagaaaaacttgatagtgaagcacaaatgtatcatgttttaatgacattttagatgtcttttccttgaaaggaaaaaaaatatatatgccaaactatattagtgatacaaatctggagacttattgtcaaacatcaacttaaaacttgttcatccattgattccctcatcccactaatccattgttcagtcatttaactactaataacaataccaactgctaaccttttctgaaattttctatgtgccaggcactgttctaaattcttaaatgtactaacctatggaatcctcacaagtctgtaagtactattattattatccttttgaaatggagtctcgctctgtcacccaggctggagtgcagtggtatgacttctgctcactgcaacctccacctcctgggttcaaacgattcttgtgcctcagcctcccgagtatctggtattacaggtgcctgccaccgtgcctggctaattttttgtatttttagtagagatggggttttgacatgttggccaggctagtctggaactcctgacctcaagtgatctgctcaccccggcctcccaaattgctgagattacaggcgtaagccaccatgttcagccaagtaagtagtattattatctccactttaggtataacaaaggtgctaagtaatttaccaaagatcacatgttggctgaaatggaggcagtttgactgcaggatacatgctctaaactgttatatcaccctatgttttgaaggttaattaatatctactttgcatcagggactgtgctaaattaaatagaaacctccaagaagaaggcagatacacttcctgtcttcaaggaactgcagtccagcagggaaggcagagattgtaacagtaattacatgcaatatgacaagggttccaatagaggaaatataaggagaagtacaggtgctatgtgggtgaacaaattgttgtcagagaagacctaggagaggacaagtgagtgctatgtaaacctggtgatagccttccacataggtgatctatcaatgcagatggatagtaaattagacaattatttagactcacatctggggccagactgtgcacagaagattctaggtgccaagaaagaacagagagagatggggcaggtctttggctttgcactttctatggaggagctgtgctgtgaggtgacgaaggggaggtgggggtagggggaggtagaggtagaagcccgtagttgtagaacgagaagaatgcagccaaagaatgaaagccagaggagagttagccttgtgacatcaaacagattgaagctgtaaaaaagtgagtgttttatcattaaaattgttaatgttaaatttctgctggaatatttcttgtatgcttccccaaataggctttcctcataggacttacagaaaacataccaatgggacaataaaaattttacacagattgtgaatgtatttattcattttctctatttgcttcaaactgaagctaccatcttcttttcatgcttattgatatttcttaacaaaactgatatattatcctatagtcataaatggaattgttggaaggagcatgtggcctagttcctttatgttataaatgatgataacagaaagccaaaaagtccacacaaaaccagaaactctaaatacagtgtgtgaaggaaataaaaatgcagtatgattatggaccaaattatgtacccccaaaattcatatgttatagtcttaacctccagtacctcagaatatgattgtacttggagatagggcctttaattaggtgattaagttagcacaagtcttttagaatgggctacaatccaatctgtctggcatccttatatgaagaggaaatttggacacaaaaaggaacatcagggatctgtgtgcacagagtaaagaccatttgaagacacagtgagatgtccatctacaagccaaagagagccttagaagagctctagaagaaatcaaccctgctggcaccttccagtcttcaggactatgaggaaacgaatttcccttgttgaagtcacccagtctggtattttgttactgcagttctagcaaactaatgcatactcacatacttttatatttatacccacatttattctctccatctctccctcccttcctccctccctccctcaagccaatttcaaaagcactttcatgcatattactgtatttgagtttgatagcacttttgttgaaaaggcaggccaataattaacttcactacatggataaagcaactgaggttctgagttcataagttactcacagatactactagaaataactgagctagaatttgaatacaggttttctaatttttcaagtccaacatcctctaaatgtaaccagtctctctcagcaccactagtatttctggaatgcatggtataagtatgaaaaataaaaaggaaataaatattaaatttgctagtaacatgaaccaaaaaaatcaatcaataaaacataacatcaaccatagaaaaccagtaaattaacacaacaaacctaaagcttattaatcataagcattagcaatcttatttttctaggggtcttctggttcccaccttctgtcttttaaagcaagtataaagagtatttttcagttattggcaaaacctcataatgtattcttgcttctcctagctttatgcggtttgtttaggctacgcactagaaaacctctctgaaatatggtggctgttttacaccaagcggatgtggttctctctagagtcagtatctaagggtaatgtcagtgtccctttgataatttcgaagatcagattctttatgagtcatgtttacgatttttctttcggagagcacttgattgtctatgtgtgccaagcacagtgcttcttattgcagccaaggcagtcacacgcgaggtcacttcacgtggctctagccttaatgcttctaattgtgaacatgaagcttgcctcctgtacataaatccatgatgaaaaagaccatatgctgttatatatcaacataaatttcccaaacaaatgttcatatctttgcagacacaaggcttctgttcctccatccacagtagggaaataatatttgtatgcaggcatacggtaataagacctagttaccttcaaattcttacacttatagttcactgccaactgtttcctactctgccaccaacaggtgctctagcataaagcatttgggtgaggagacatgcacctcaaatgctgggaacaactcttttttagaagaaataacagcttctcataaatatcccagtcctttaatgatatgctagagaggttgtgatggaagacccctgtgtgtggtgatttatgtaagggagcagatagcttcaaacacattttatccttcagcttcctctcaaggtagacctaaccaaagcacatggagaacaatttagccaaatctgaaatgtaacaacagaatcatgccttttgtgtctcccagattattctgtgaattcaagggaaaggtatagaggtgaggcaagcaaggtgacagagctaaaagaaaaaattggctttagaaatcatgggttctagccacctaccgggcatatgagccttgagcttaacctcctcggtcctcagttttctcatctatagagtgagagtggcaacagcactgcaacttgtttcacgagtcttagataatttccagtttacgttaacatctaaccttagaattcaactcttctcttagaactaacagtttctcataatcatcctaacttgatgatatttgatgaggatttgaggatcaaagattctcatacattgaaggtagaagatgtttgttttacatgtacaaaaatacttttatctacatagaaatgttctagaaagattatgtctgggattttgatggggaaaatgaagttttaaatttttaaattgtatacctttttgcaaatgcattaatttttaatgagcaaaatgtcagtcattagataaagctgtaatggagaaaatggtttggccctgatgacaaaatggggtggagggggaggggaggatgacagaggctgcttgccagtatttctgagagggaaaggatttctattttatgggctgaagaaagaacaaagagaaaaaaagaacattgtttcctacaattcctgaatttttgtttccgcaacttattttctctggggggcttactcatacctttattatcatgtaaattgatacaaccttgttgagaggtacatttgatacttgtctaggtcgaggaatagtcaggagaaaacagcttatcccaattttatataacatagccacatacacatgattatgaatagtctatcatagttaacatttagtgtttactttgtgcctgacactgtgctaaatattatgcatagatctcatttagtccttagaaaattctataagttaggtattattctcacttttctgatgaagacaactgaattcaatttataaccacagcattcccacttctgtgtaggtgaactggagtttgaacccaggtcttttcaactccatctaccgtgctgacacagccaggtgtgggaggcagtgtggcagcccccatatggctggcctgctctggctgcttctaaccactagtccctattgtgctattattattattatttattatactttaagttctagggtacgtgtgcacaacttgcaggtttgttacatatgcatacatgtaccatgttggtgtgctgcacccattaactcgtcatttatgttaggtatacctcctaatgctatccttccccactcccccgaccccatgacaggccccagtgtgtggtgttccccaccctgtgtcctagtgttctcattgttcaattcccaactatgagtgagaacatgcggtgtttggttttctgtcctggcgatagtttgctcagaatgatggtttccagcttcatccatgtccctacaaaggacatgaactcatcattttttatggctgcatagtattccatggtgtatatgtgccacattttcttaatccagtctatcattgatgggcatttgggttggttccaagtctttgctattgtgaatagtgccaccataaacatatgtgtgcatgtgtcttcatagcagcatgatttataatcctttgggtatatacccagtaatgagatggctgggtcaaatggtaattctagttctagatccttgagaaatggccacactgtcttccacaatggttgaactagtttacagtcccacgaacagtgtaaaagcgtttctatttctccacatcctctccagcacctgttgtttcctgactttttaatgatcaccattctaactggtgtgagatggtatttcattgtggttttgatttgcatttctctgatggccagtgatgatgagcattttttcatgtgtctgttggctgcataaatgtcttcttttgagaagtgtctgttcatatccttcacccacttgttgatggggttgtttgtttttttcttgtaaatttgcttgagttcattgtagattctggatattagccctttgtcagatgggtagattgcaaaacgtttctcccattctgtaggttgcctgttcacgctgatggtagtttcttttgctgtgcagaatctctttagtttaattagatcccatttgtcaattttggcttttgttaccattgcttttggtgttttagacatggaccttatacaaaaattaattcaggatggattaaagacttaaatgtcagacctaaaaccataaaaaccctagcagaaaacctaggcaataccattcctcaacttattgatcttaactcaagcccaagtcaactcatggtgggttgtctaccttgaggcaaaggtctgaagtttagcaagacaatgattttagagggattctcccaccagaagcaacccctgctgctgggatggttggtgggtaattcagcttttagcgccaaaacaggaatgatcattcaggcttttctctagggaatgtcactcacatgagcgtctctgtgaacagagatccccacccccaatctctacagcccacacaacagccctccagccagaaggatcgtagatatgtggatatgtttttgggtatggatcagcagggtacatcaattatgttgactaaaggccaccttgcaccatgggctggaagttcattgtctgttctgaatctcatttcaaattatatggaggcacattacctgatacagtacaccagaggttatgtaaagggctcaaatgacaacacaaaaatacttaaattaatgcattgcctggaatacaaaaagtactccaatctgaatgatatgaatcagttattaaattcccaaagtgaaagcaaatttcaaaaattaaattggtattttaattgaagttccaaagaattcaagtatttccaaattccaaatatttcctctcttaagtttctctgttcagtcccagtagaatagagcttcattcacttgggtggaatcactgttttttagtagctgtttctgaagctctgaagttgtatcattataactgcaagttcttcatgagctttaccttttggaatctaaagtgttcataaggtatgaaagattatataagcatcagaacaacaactaagattttttttaaatcacacgcacagatccccagtaccaaaatggtaatccaaacaaaataacgttgacagaaccagatacataagtacattctagagacacattactatcaacagccaaagaccatgcagagatttggttttactacatggaggacaggaaactgcatgtagctgatgaggtggtagggattgaaagggaggacagagacagagttagagatggagacagagagacagaaagatgtattatctttaaaatactttaaaaactagggttttttgttattgttgttgtttttttttttttttttgagacggagtctcgctctgttgccaggctggagtgcagtggcgcgatcttcgctcactgtaatgtcaacctctgggttcaagcaattctcctgcctcagcctcccgagtagcagggactacaggcacatgccaccacgcccagctaatttctgtatttttagtagagacgaggtttcaccatgttggccagaatggtctctatctcttgacctcttgacccacctgcctcagcctcccgaagttaaaaactagttttaaaatgtagatctaaactttttgggaagtgatgtcttagttggcatcaaaatgcttaatatggtgtaaaactggaattttgagtagaattgaagttcagacagcttgagagcagattctctgactgattgactgtcttgtattccatagtgcctagaaaagtattactgcacattaggtaccttttaaatattccttgaaaaaagccttttaagaatgtgtctgtatattaaaggtaccttcttaatgcccttaaggttgcattaataattcttaatatgtttattaaccaagtttaaggatagtcagatccttaaagttgagaatcctgaacatggtcatgaactttccaggctcatatgactctcactagccctactcttcagtgtgctgtgcccaccaccctggccttttaccccgtctctgaattatcaatatatgccaggcattttgataattgcccatatatatcattgcatttaaccttgatacttatcctccttttaccaaggaggaatcaggctcagagaatgaagggacaacccaaaatcatacagctggtaagaaaaggtgtgagaatttgaactcaagatttgaatgacttgaaagcccattattttaaccactttgctatcctgtagtgggctataatagtaaacgtttgataccagaatttgtgctcctattgaaatataactatacctctcagttcatacactctacatggcaaatatatttagttatagttatatagtgtttccatgcaaatcagagagggagcacactgcaatttctcatagtatagtagaacagataactggaaaatactgacaccacagaatactttgatactcccttgagtaagagaatagaggataccctaagttgtttagtccagtgataattacagaaagaactggaatcttcaaacaaggataaattagtcctaatgcaacatacgttttgttcattctccaataatatagatctagaaagctttttaaactttcagggtagccagacagtcagaaagtggtacatgtacgtaaaagtgtaatgtgtgtatgtgtgtgtgtgtgcacctgtatctcatcttttgaacaaagtatcattttttagtaagtagtgagaagcctattatcttattctcttcatttaaaacacgcatcttgtcctccttcccaatttgtgcaccatttcccagagcctctcctgcattttcaaattctaacacaaatgcattaaaccgcatgctaggcaaaaatcagtagacgttgttatgaaaaaatttttaaaagaaaatatactgcctttaactgcttatatgcataatatataatgttccacttcagctccttcagttggggagctgtgtgggtcagtctacacattggctgcagagtgtgctattcctgccaaatcatccagttgagatgggaacattaatttatttgagcagacgtgtgtctatgtggctttaacaaaacagccatatgctgctctagtaagtaatgtaacaaagcggcacaattgatgccagaaactatcttagaacttttgacaaggagcatggagaaagttccttcttcaaccttcttttgcagtggcatttcctttattctgatgatcctctagaccaatatcgtccaatacatatggttttaatttagtgtgaattttctgtgaggctttgtgttagccccgggttttctttttccatttaatggatttttattaggggtttcatggcatagccatagttccttatacatatattcccctctcctccccaagaccttaaggggaggggtctcttacaataggaccaaagtggggagtgggagccaggtattgctgaaatcctctggccaaataccatctttaatagatcttaatgacatcgctatagtcccaagcccaaccctcagccttctaagtctgcttttcccagaattggtgacattatttttgtagataaaatgtattttacactacatgcaatacatacaaaacattcagaaatataaaaatgtagaaagctggaaaacccttagactacccccaaatgactaactaatgtcttttttttctttctttctttttgagacggagtctagctctgtcacccaggctggagggcagtgtcatgatctcggctcactgcaacctccgcctcccaggttcaaacaattctcctgcttcagcctcccgagtaactgggactacaggcaagtgccaacatgcccggctaatttttcatatttttagtagagacggggtttcaccgtgttagccaggatggtctccatctcctgaactcgtgatttgcccgcatcggcctctcaaagtgctgggattacaggcgtgagccactgcacccggccatgtcatttttttgtgcattttttactgtaataattttaagtatactttttcaatataatatggtcatgaacatattgtatatgttgtttttgtgttaatatagtaatacaagcattttccccactgctatgaattcttttaagcaaaaaatgtaatggccacaataattccattgtattatagactaaatactttcagagttgagatattaccaatattttgctataacaataaatgcaaatgttaccaacatagtacttagagatacctgctgtgactagttgcttgtgtatctttccagaaatatcgattgcttcataaacatatatgttatggatgtatttaatacaaatgggcttatgataatcatattctgcgctgttataaaaaagtatacatgagcaatataattgtcataggcagcatattctgtgattaggacagattctagagataggctgccagaattggattctgaattcaacacataatagcttttgcaaccttgagcatattatttaacctcagtttgctcatctttaaaatggatataataatactacctacttcataaaattgttatgaagattaaacgtcacatgataagcataagacaggcatatgttaatttttttaaaacttcattcttttttacagcagtatagtattacgtattatggatgtaccacaatttgttttattcattgacatttacattgttgtcagttatcatctatttcatgcaaaacttcaataaacatctttgttaatttatcttttacatgtgtaaacgcatctgttacagctgcagtcaaaatttctaaaaatgaaattgccgagtcaaaagacatgtatgcatttttttaaacttttattttaagttcaggggtacatgtgcagatttgttaaataggtaaacttgtgtcatgggggtttgttatgcagattatttcatcaccagctattaagcctagtacctatttaaaacaaaaaattaggaatggctcaatttcccttcactacgattatactaattttacttagacattgcggagtatgtctccctattctttagctaagaatggttttatcaagctttttattctaggtaaaagaagtgatcctgctttaactttcattcccctaattatgtgtatgattgaacatctactcataaatcctaaggtcatttagaattcttcttaatttttttctgagaaccacagagtcatgtcctttgatcatttctcaaaattgacttgttctatttctatctataagagtatattttaagtagtgtaatcagtgttgaatctaaagtggtgaaaaaaattcttaattagtaatttccttttaacttcctttatgatacttatttctatgcaaaatctatttctcatcttgcatgttaatatattattaggttaaaaaataaagaaacgtattattgttctttagctttaatctttgccgtttctggtacttggcagactaaataacaactacaccactaactacccctccacatgcacagatcgcctcacgaaactcttcatatatatatatatgtatatatatatatatatgtatatatattatatataaaagattattatatatatcatatatgtatcaatttaaaattcattttggtaaaataatttatgtcgagatttaaaatatatttcctccaaaacttttattactgtctgtaattgccatcctaatgaaataaaaataggttgtattaatttaaatacctttctgtattcactattttttcactactctgttcttgttcctaagatgcctttaagcttagaaagccttccccttctgatacgatttttttaaactaccacatttactgttttattttattttaacatctagctcttcagctcagtggaaatttattttgaaagacgtgagatctcctaggctttcctcttattactgttctggccccattgttattcctctagagataaaacataccaagttcataaaaaaattttcatcctcacacatttcctaacagcatatatttatcaggaactcttaatagtttcttgtgcatgatcaattctgagtctttattcccaaatttaacacatttgtttctgcctatattaatatattaacatacttaatggttatctgattgagaagggtctttgggtaaccaggatggaggaggaggtgttgaagatatctgtttatagggctcttctgcttagaattctaattgaggccattttaagaaagttgctccctgttaattcaccaaaaatttaaacatgaaacaatctattaatgtgtaaatattaatgttaaactataaaacaatatgttattttatatctacttttatatagatttataaatatttgtatttactcatattttatctatatgactttattatattcatacaaatattatattactatatggatcaagtctataaatggcacatttgttccttaatatattattgctgtgctccagaaatactgctaaggaaatattgctctttaatcaaaggtctcagattctaaggacactgttgctgcattctcctttatgtttctttgaataagagctcccattcctgtgaaaggtgctggagtgatggagaatggaggaggcacattctttactctttttgttgttgttgttgttctttttttttttttttttgaggtggagtttctctcttattgcccaggctggagtgcaatggtgcaatctcagctcactgcaacctccccctaacattcccctacctcaagcgattctcctgcctcagcctcccgagtagctgggattacaggcatgcaccaccacacccggctaattttgtacttttagtagaaacagggtttcgacatgttggccaggctggtcttgaactgacctcaagtgatccacctgtgtcagcctttcaaagtgctgggattacaggcatgaaccaccacacctggcctcacattattactctttgtctctgttttttcaaggcgtcatacaatgctattgtcttcagttatatgattattccacaaatggattcacagtgcacgcgattgtatttgaactcttttggttgcaatccagttggattgaccttgcatacaagtggacccaaccatacctggcatcaagaagtcaaacattcactcactcattcaagaagtatttgttaaacatctactgtgttagaaactgtgcttggtgttatggataagatggtgacttaaacatgccccctgccttctggcagttcccaatctagggaagaaaacagcaagtaagcaagaaattgtaatgcaaggaattaggatacaaatcaggaataaacacagtatgaaaaggtggggtattggagagcttcaggccaggcatcctgtgaggagtgaaatcagtgctgagattagaagaatgagtggggactagaagacgttagtaaggcaactaactaattatgtgtatgtggaggggtagttgatggtgtggttattatactagtctgccaagtaccggaaatggtgaagattaaggctaaagaacaatcagtatgtttctttattttttaaccgagtcatttaattatcaaggattcttacaaccatttgcaattcatttcaggatgtattgtgtctagcattaattattcttcattcattataagtttgttttaccaaatcactctcagaagaagaaagaggacctaagagaagtaatggatgttgaaaatgcctttaatctttataacagctcggtctaaataaatctcagaaagccgaagacctaacagctgctaaatgactcagttaagatttgaataccggtctgtctgatcaacttcaaaatcccatactttttctcccataccatgcttatctccttctgcgattttagatggtgacccaatgcctcttcccagattctacaaatattcttctttcagtcttctttaattcatttcttggataactgaagaaaaaaaaaactaagtaacagtgttcttttatattacagcctagtttcctagtttttacagagtgaaatgctgtcagggaaatgggaaatgttttctgcaaatatatgataattctataaacatttttaagacttcatatgatgtatcctctctggaatttatttttttcctgaaaaaaatagtcactaaaagtgattcaaacattagctagaccttctgcaagcccatgtttctgccttcatcaattagagtggctttagctgcttcggcaaaagcctgactacagtaacttatttcagtagaagaggcttcatttttctctggtaataagacatctggaggtagtccaaggctagtgcaggtgctcaggaagccactgagaatccaggaactttctagtttctgtgattgaaattggctcctgcactgttgggcatgaggctaaactccaggcagaagtagaggtggaatcaaaaggccagtgctccttgaatgtattcccttgtatcaggggaacaaaatcatttccagaagcaccacttaatggacttccatgtatgttaaatagctatcacaaggtgcaagacagcctcggaaatcaggcttttcagctgggcaaagtactgtccatatatagttaggctttcttgattaggaagaaatggagactagataagacacagtgtgcaaaatcggcaatgagaaaatcagctacacactctaagcagtatgatgcttctaaagctcacctcaagttatacgaatgttactacccttatccaaacaggcattataaaatctattagaagctaagaagaaaagacatttatctgtaaaatgaatagcagtatcaaataagattgtaaatcactataatagtgttagagtttttggctaatttgtttttaaagagagcatcaaagagattataattagaggaaaaaggataggtctacattttgttccttccagctatgggatcttagaacattcacatagtctgtcctctcaggcaaatgtagttccattgcctatgaaatgataccagattaataaaaggggccagagatttaaaccaacattttttgaagaaaaagaaacatcacaagtcaataaaccagtgaagtgatggtcatcctcctttgtaatcagggtgataaaaattaaaaacacagtgaaacatcactttgcattcataagatgggctaaacttaaagactgacaatatcaagtggtgaaaaggaggtagagccaaagttggtgaattccacaggccaaatctagccttccacccgcttttgtatagcccataagccaggaatggttttacatttttaaatgaagagtttaaaaagactattagcctttcagggagaatagttgttcaattttgcctcttgatgctgaagcctaaaatatttactatgtgacactttacagaaaatgtttgctgacgctgatacaaaaagcatgggaattctacactgctggtaggagtgaaagtggcataaacacttctgaaagcaactttatgtatctagtgatatgaataggtgcaaaccctaggacctagaattactctagaaaactcttgctgattctatcagcagtattcataaatggaacaaatccaaacatctactaacaatagaatagaggaataaagcatattacaacacacagtgaatactgctatagacagcaatataaatgagactcataaagaaggcactaagaaaaatacaagttccagagtagctctgtccaatagaaatatgatgcaagctgcaaatgtgagatgcatatttaatgttaaaatttctagcagccatattaagaacataagaaaaaacaggtgagattagtttaacaataaatttgtattttatttaaggtaatatgttcaccattatcatgtcaacatgtagtcaatatgaaaatattaacgatatatatcacattattttttgttctaaatcttggaaatctgaagtgaattttatatgtgcaggacatctcaactgggactagccacgtttcaagtgctcagtcacatgtggctggtggccatcatgttaaacagcacagtttgagaagatgcaaatggtataattttacttacatcccgtctttcaaaataaacaaaactatatgttatttagggacacatgatatgtgttaaaactacaaagaaaagtaaggcattcataaacccaagatccagatgaccatgacttctgggagaggagggaagaggggcaccaagatagagaactggttcctgggtactcagaggagctgataatattctgtttcataagtttgatggtaggagcatggatgctttttaaaattaaatagacattatcccgggtgttatggctcatgcctgtaatcccagcactttagggagctaaggcaggcggatcacctgaggtcaggaattctagatcagcctggccaacatggtgaaacctcatgtctactaaaaatacaggtagctgggggcggtggcgggaacctgtaatctcagctactcgggaggctgaggcagcagaatcgcttgaacccgggagatggagtttgtagtgagcagatatcacgccactgccctccagcctgagtgacagaacaaggctctctctctcaaaaaaaaaaaattaaacagacattataattattattttgaagctatttcatctttcataaaaatttaaaactaaatctttgcaccaggtgcttatctcagagagaagttataatgcaactgcttgtgcaaatactttttgaacagtaaaacagaatgtaagcagagacatgttagtatctattattgttccttttaattttataattggaaggtccatatgtgcaggagttgccacaaggtagggactttaaatagacagaactgagcaatacaagagactgtaaactgttagttgactacccacaaaacagaagaggagaaatggaaaaaaaaaaatcaataaggaagaaagaaatctgtgtaagtggcagcagagacatgtggaagtcttgaagggtgaccagctgttgcatctctgagatttgtcaaaaaagacttgtgggggagagtcaactgacaggaagctgtcgcggaggactgggagagggatctgaaagtgacatcctccggggtgggctggagagcaggaaactatactgggaaagagccccgggcagatgcggtgcttgaggcaggtcctagtcggctgcacagactgtctgcagacaaagagttggagttggcagcaggagtgagtgcttggcagagtcaaggcggcttctttttctggctctgccactctcccatcttaccatcttcagtaattggcttgaggcagaagagatgatctctctgcagttttcttctttctcatctaagatggggtgaagagaaagcagacgcgtgcatggccctgtgacaagagcatagagctgtgtagctaccaggctggtccttgatgtgacctatcgctctccatctgtgtttgagaaggtagagaagccgcggtcggggccttgaacctgccaggttttccaaaagccccttctggtgaagcactatgcaaaaggggatagaaatgggtgcccctttggaagatcgcatgttcatgcagctactaaccctgcacatccagggctaaatttttttcagactggggtttgagagaactccggcgaccaggataaaagagaagaaataaaaatacttctttgttattcactatgaaagttgcatggtgaagagttttgaaaattgtgcctaggtgcctgtggatgggggttgggttttcttgggaacattctctctgagaatttacaaagtaactgacttcctaatggatgacaggtcttcactccgcagttcagcacccagccctctgccagctcatgcctgccacatcttccacttcttagtgcccttcagggaaactaggaaagtgatcagatcaaggcagcaaaagacagttgatcaagtctccacataagcagagcaagtgtgcactgtctcctgtcatgtttgataagccccactgtgtgccaccagaggaggcactttagacacgtgatttcgccaaaactccacaacctgcatgagagaaagaaattctttttcccattttatatgtaaggagactgaaattcagaggaggaatgcctcacctgcaattagatgctgagctgggagctgaactctttttaatctattagatttcaaagttcatatttgtcctactgtgttgtgctatgtactaaatttattgaacatgaatttagtgcaggtgttttacatacacctgatttgatccttacaactactctgaaggaaatgtgcttgtaatattgtccttattttattagaaaggcaatgaatgtgaaggagaggttattttacaaagccggttccttatagaggcaaagaattgttttttaatttttaattcaacttttattttggataggggagcacatgtgcaggtttgtcgcatgggtaaattgcaccaaactaaagtttggtatacaaatgattctgccaccaaggtagtgagaataatacccaataggtagtttttcaactcacactttcctccctccctcccctgtctagtagtctgcagtctgttgttcccatctttatgtccatgtgcactcaatgttcagctcccacttatgagtgagacatacggtattaggttttctgttctagtgttaatttgctaaggattatggcctccagctgtattcatgttgctgtgaaggacataatttcattcttttttatgactgcatagtattctgtgatgtatatgtaccattttttttacccaatccactactgacaggcacttagtttgagtccatattgtgatgattaatacagagtgtcaacttgattggattgaaggatacaaagtattgatcctgggtgtgtctgtgagggtgttgccaaaggagattaacatttgcatcaatgggctggggaaggcagacccacccttaacctgatgggcaccatctaatcagctgccagtgaatataaagcaggcagaaaaacgtgaaaaagcgagaccggcctagcctcccagcctacatctttctcccgtgctggatgcctgcccttcaacatcatactccaagttcttcagtttttcagttgtaagtttatcctgtatcattttcccccagcacacaacataccagtcactcttacctcctttctctttctcaccaagattctttctgtctcctaatcacaattactctttctttcaccagaaagtctctagccataactctttttatgggtgcctcattctctccttcagttttcactcagaagccatgttagaaagcccatattgtccattttatctaatgtgttattactttgaaaaacaccacctcatttactttcttcacaaatttcatcatgattaatcattgatttgtttctttatttctatatttcctttctcctctactaactctatgaaagcaacaactttatatctattgtgttgctgatgtctagtgcctatcaaagtgtgggtacagaataggcactcaaagaatactttctcaggaaaacagttttttatgcagtaggtttttatttaattatattatatgtggggggatattctgcagtcttcaaatgctctaaaatgaatagtaattcttctcatctaaaacaataacattttaaactatattgaatcagtgaatacatcataagatcctgttctcaaaataaacaagtttcttgaatgttacatgtggagaagtttgcacacttggaagaaaaagaaaccactatacccgtggcttgcgctataccaaattagaatgaaaaggaaaagcatatctgtcttgaaattacatttcagctttcttcgaatgggatagggtcagggaggcaaatggtttggagaaataaagattcaattgtttaatgtatctttcatacatatattttgtcaaaaagagattcctagaaaccgggaaaagtactagaagccaaagtggcttgtctcaatttatagaattaatcaaataatgttagtctttatccattctcaaaggacagcttcaagaatcaatctaaactttaaatatgctgaagtgggtttgtagttgtagcccaaacagaaagactgggcgatatagttaggatatttgtgcccacccaaatctcatgttgaaatgtaatccccagtgttggaggtggggcctggtgggaggggtttggatcatggaggcagacccctcatgaatggcttgctccatgccctttgtgataagtgagctcttgctctaacttcacacaagatctggtcatttaaaagtatgtggcacctctcccctgaatctctctctcttgctcccactcccactctatgagacacctgatcccttttcaccttcctcagtgagtaaaagttcactgaggcctccccagaaaacaatcagttgccagtggcatgcgtgtacagcatgcaaaactatgagccaattaaacatcttttctttataaattacccagtcttatatatttctttatagtaatgcaagaatggcttaatgcagaaaattgataccaaggagtggggcatttctataaagataccttaaaatgtggaaatgattttgcaattgggtaatgggcagaggttggaagtatttggagggttcagaagacaagaagatgagggaaagtttgcaatttcttagagactggttaaatggttgcgaccaaaatgctgctagtgatatgcacagtgaaatacaggctgacaaggtctcagatggaaatgaaaaagttattgtgacctggagcaaaggtcatatatgctatgccttagcaaagaactgggctgcattctgttcatgccctagggaactgtggaagtttgagcttgagagtgatgacctagggtatctaggggaagaaatttctaggcagcaaaacattctagatatcacctggctgcttctaacagcctgtgcttagatgtaggagcaaagaaatgacttaaagttagaatttatatttaaacatgaagcagagtgtaaaagtttcaaaaatttgcagactagtcagtggcagaggaaaaaaatgcttttttgagagaggaattcaagcaagctgcagagcaaccacttgctgaagatatttgcataattaaaaaggagaacgactaatattcaaaacaatggggaaagacctcaaaggcatttcagagaccttcaaggcagtcccttctgtcacaggcttagaggtgtaggagggaaaaatggttttgtaagcccggcccagggcccctcttccttgcacaagacactgcttcccacaccccagccactctagatcaagccgtggctcaaaggggcctatgtacagcttgggctgccactttggagaatataagctctaagccttggtggcttccacatggtgttaagccagtaggtacacagaatgaaagagtaaggaacacttggcagcctccatctaggttttagaggatgtatgagaaagcctgggtggccaggcagaaggcttctgcagggctggggccctcatagagaatttctactagggcagtgccaaggggaaatgtgggaatggagccctcacatgcagtgccccatgggccactggttataggagctgtgagaatgtggtctctgtcctccagaccccagaatggtagatccattggcagcttgtatcctgttcctggaaaaaccacaggcattcaactccaacccatgacagcaggcctggagactgaaccctgcaaagccaaaggggtggagctacacaaggccttaagaatccacctcttatagcagtgtgccaggatgtggacattgagtcaaaggagactgtttttaagctttgagatttaatgactttactgctgggtttcaaatttacatagggcctgtattccctttctattggctaatttctcccttttgtttattcaatgcctagacctccattgcatcttgggagtaaataacttgttttgattttataagttcatcagtggaagaaactcagtttggatttgggacttgggacctttgagttaatgctggaatgagttaagattttgggggaacttagagaagggatgattatattttgaaatgtgataaggaaaacatttggaaggggccagggcagaatgatatttgtccctacccaattctcatgttgaaatataatccccaatgttggaggtggggctttgtaggaagtgtttggatcatggggtggatccttcaagaatgacctaggccatttgctttgtgataagtgtgcttttgctctgagtttatgtgagacctggtcgtttaaaagtgtgtggtgcctccccatgcactctctctttcttgatcctgcttccactatgtgagacaccttctccctcttcactttctgccatgagtaaaagctccccgaaacctcccaagaagccaagcagatgccagtgccatacttgtacagtctgcaaagttgtaagccaattaaacctcttatctttataaattacctattctcaggtatttctttatagcagtgcaaaaatggcctagcacactgagtcaacatttattgagtgcctacactttggaatttttgctaggtgtatggaatatgtttccatatttgacatatacgtttcctaacttacctgcaataacagagtcagagctagtaaccaggactggaaaactgaactctcctagatttcatagtcaatgttgtttccattgcagttttcttttctgtggaaggaacctcagtcaattgactatggttcttgaagtttttacaagccacttcagagttttcttcttctcactttgaaatctttatctgagttttctactaaagacctcaacacatggacatgtaaacacagttgaggtattacacgtttggtcagtgttcaattccccaatttcatctctttttaaaaaatactgtaattaattgtattcatgtgccatggcacagccggcaagcattttaaccatcaccaagtatttagagatgcctgtgaattaaattcatcctcagatgagattccatgtactcataatccagacttccctatgaactttgttgttggcctttctggttgaaaaatagaaaatagagggacctttgtaaaggcagcataaattacataaagttcaaatcagcaggagaacaacaaagaaacacaaacaaatgccatcctagagaatcttggtgggggataaggtgtttattaaggatgacagaaacctcctgatagagacaatatcattcaccttatagatccatctctgtagctgaaatgtgttgagtgaaatttgatctaagcataatgggacttggtgtgaacccagatttaagtgggaatgtgggtttgggaggcaggttttgtctgagacttcagaggcagcactggggcagacagtcagattaccacctgggagttcatttgagaatgtaccagagagtaagaaacctgctgaactccaagaaagacagtcagaaaactgaagaagtaagcaggaattgaagaaaagagccagggatctgacacacaaagtgcctggtgaattttccttaagagtttgccactgttttagccagattccattgacctggttacctggtagaacaaggtagaacctcattgctagaggcaacccattgcctttgaaaggtaactagtgggaactcctctgaacatcagacctggcctccctttccttttaggttaaacacaaaggctatatgtaatctggctactttcttcttctccagcctcatcctcaaccatactttttccttcactctctgtactgcaaccataatgtctccaacatcttcttttctgctttcagatttgccttaacagtctgtcctcctccttcatctatttaattcctcacttattcttttgatttcaactcaagtgtcattacatcaatacaccagaatgggttgatccaggaagcctctgtttctgtttaaatcatataaaaatatgctggatacaatataacaattactttaaaaaatacatgcataagcttgtacatctctctccagctgtaagaaacaaggaagaaactcaaagccagagtagtatgtaaaaatgaaagctcagcaattcccaggtgaatcagaaatctacctccatctaaagggaaagagctggggtttcttttcactttcttctctccctttcctatttgtttcctgtcaggacagttcactgctgtaactatttattttagctggtgtaccagaagacgaatatgtttggtaaacaaaagagagccatggtgtcccagagaggggagtttgagctacagcagggtgagattatgtttgatcatggctgtcaaagcctgagagggtaaagagagtatcatgcaggggcatccccttgaaggcagactgatgtggaatattaaggtccaagtaggcttgacaatatatatgcatggggagaacctagcacagggagctagaatccaagtgtggcaaaacggatgttcatgcgtgcaaggatatggcttggtatgtgatgtcagagtccaggcagtatgaggtgggtatttctttagaaagtcagccttgcatggaggatgaaagcctaagtggggtgagaccctacagagattgatgatctagtgcagagtatcaaagcctaaatgggagtgggtagagcatccatgtgggagaagactggtatagagtatcagagaccaagcatagtaggagagcattttacaggcaatgggggaggggtgtggaggacagagagccaaaggaaggattggagtctacatagtgagaagggattccacacactggggcagtctaacacaggtgtcagagccttccttaaggagaggatcccagtgagagggaatttacagagacccagcacagagtgtggaagcatatatagggtaaggagcccagtgagagggagtttacagagacccagcacagggtgtggaagcatatgtagaataaggagagcctctgcttcaggaaggtgctataatggcaatgggagattggaagcatacaggtgaattgattagataagaaaatatgttaaggataatggaagccagataactcactgttggagaaaagagttccaaacaggaaacaaatagaacgagtcatttgttgttggatttgaatttaatttattacggtgaatttgtaattttcaatatatacagacagagagtaatagaaatataaaatccagtcaaaattctcattttaagacacttgggccaattaaagcaaagaaggaagacaaaaaaatcaataaataataggttgtggtattagtgtcctagatagaatattgaaagtcaaagctggtactgagcccactggctaaatgctgggagccaagaaggtctgttaagtccattaaaataggaattagatacatctcaactctcctaggattgtagctccaaatggggcaggctaccctaagccatgtaaagaaagaattacctgtgagataactaatcgtgagcctgtggtgtgccttgacctgtgatctaaatttagaaaacatatgcaatggaagcaactccaatagaaaaatgctcataaaaccctagtcactctaagaccttactcaggaggctctggcaatttcctaacaacacaattgccagtgtatctatccatctacattccctgtgttatcaaatccttcctacctcaacaagtctttctatagccttatttattcagagacttttagaaccaagttcttaattagttattctgtggttccagtcatcatgagtcagaatgtctgggaattcaaatccaattagaatttctaaagaaaaatgtaagtttggaattaggtatgtggattcaaagatgtcagtggaaatgccagcggacttttgctgataaatgggaagctaagaagacagtggccaaagctagagctattggttgtggtaacatggcgttgatgatgatgatgatgttgatgacactgatgatgatgatgatgatgatgatgatgatgatgatgatgatgataaatcttcattttgtgcttcccatgtgatagacactatgctaagtgcttcatatgtactatctcatgtaatcctgaccttaatgttataaaggaagtacactcattatatagatgatcaaatggaatgactgagaaattagtaactttcttgagtcttcatagtcaacaagtgttagaaccagtatttgagaaatctgactttagattcttacctgtacttttagatctatactcaaccattttgcaaccaagtacactcattgtatagatgaacaaatggaatgactgagaaattagtaactttcttgagtcttcacactcaacaagtggtagaaccagtatttaagaaatctgactctagattattacctgtactttaaatccatactcaaccattttgcactataataattttaagaaacaaacagagaagaaatcagctaggcataaaagacaagatgtggagtggaaggaaagaaatagaaaatagcaaaaaagacaagaggaaaacatggtgatagaagggaacctagataaaaatataatctggaaagttgaagaagcaatgtaaagaagaaaagagttgatcaaaagttaaaagcaatgccctgattgagctcttagagaaattctatagattggataattggaatgtcagagatgattatttcagcataaatgtgtatttcaaatcatgtattctcccttctattccctctgtctttactctcttcccctaaaagtattattcaggtcaatatttcaaatggacttggagctggtgctaaaatctacatattttgctattgagcttgacctaaatggaagtattattagtatgagagtgaggatgtgagattaagttgtgatattcaagtcctacttgcagaaaaatcttcagaatggagctcctgatagagcattttctccagcccagaatggcaaaggatggcaccggaacaaggcacattctccacatttaaggataattttttattttctctctctctttcctctctctctcacagacacacatacacaagagcaaaacattcttccagattttgaaatatactcaagaaacattgtgattctttccctagagtttgcctctaattctaattgaagtaataataatgcctcaaattttatagaatttatcacttctgtactttctgacatagcatgatttcacataaggtagcagtcattaatcgggttagaaatcagatttttggccggacacggtggcacatgcctgtaattccagcaccttgggaggtagaggcaggccgatcatttgaggtcaggagtttaagaccagcctgaccaacatggtgaaattccgcctctactaaaaatacaaaacaattagctggtgtggtggtgcatgcctgtagtcccagctactgaagaggctaagggcttgaacccaggaggcagaggttgcagtgagccaagatcatgccactgcactccagcctgggtgacagagtgaaactctatctcaaaaaaaaaaaaaaaaaaatcagatttttcaagttttattgtatttttaattaatataataattgtccagatgtatgggatatagtctgatgtttcaatccatgtatacattgtgtaataatcaattaggtcatttagcatatctatcacctcaaacattgagcatttctttgcaatgagaatatccaaaatcttctcttttagttattttgttctttttttttttttttttactaaaacgaaagatatttaaacacctttattatcatgcatggcaagcttctttaaaggttactggctaaacaaatatatatgtgattcttatttacatttattgacacatcatattactttggagaagataaagggtttatctttagtacaaaaccattatcgccataatatttcacaagtgacttgccgatttcctccattaccataaaatccaaattatcactgatgattatcccagtcagaggtaaagacaaaataaaagacaccatattaaaggaaaatttaaaaccattcatcattgtcccagtttgattttttaatataaccaaagttaaataaagtatttagaattgtagtcttcttttaatcttcttttttttgttttttattttattttattattattatactttaagttttagggttcatgtgcacaatgtgcaagttagttacatatgtatacatgtgccatgctggtgtgctgcacccattaactcgtcatttagaattaggtatatctcctaaagctatccctcccctgtccccccaccccacaacagtccccagagtgtgatgttcctcttactgtgtccatgcgttctcattgttcaattcccacctatgagtgagaatatgcggtgtttggttttttgttcttgcgatagtttactgagaatgatgatttccaatttcatccatgtccctacaaaggacataaactgatcatttgttatggctgcatagtattccatggtgtatatgtgccacattttcttaatctagtctaccattgttggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccacgctgacttccacaacggttgaactagtttacagtcccaccaacagtgtaaaagtgttcctatttctccacatcctctccagcacctgttgtttcctgactttttaatgattgccattctaactgtgtgagatggtatctcattgtggttttgatttgcatttctctgatggccagtgatggtgagcattttttcatgtgttttttggctgcataaatgtcttcttttgagaagtgtctgttcatgttctttgcccactttttgatggggttgtttgtttttttcttgtaaatttgtttgagttcattgtagattctggatattagccctttgtcagatgagtaggttgtgaaaattttctcccattttgtaggttgtctgttcactctgatggtagtttcttttgctgtgcagaagctctttagtttaattagatcccatttgtcaattttggattttgttgccattgcttttggtattttacacatgaagtccttgcccatgcctctgtcctgaatggtaatgcctaggttttcttctagggtttttatggttttaggtctaacgtttaagtctttaatccatcttgaattaatttttgtataaggtgtaaggaagggatccagtttcagctttctacatacggctagccagttttcccagcaccatttattaaatagggaatcctttccccattgcttgcttttctcaggtttgtcaaagatcagatagtggtagatatgtggcgttatttctgagggctctgttttgttccatttatctatatctctgttttggtaccaataccatgctgttttggttactgtagccttgtagtatagtttgaagtcaggtagcatgatacctccagctttgttcttttggcttaggattgacttggcgatgcgggctcttttttggttccatatgaactttaaagtagttttttccaattctgtgaagacagtcattggtagcttgatggagatggcattgaatctataaattaccttgggcagtatggccattttcacaatattgattcttcctacccatgagcatggaatgttcttccatttgtttgtatactctttgatttcattgagcagtggtttgtagttctccttgaagaggtccttcacgtcccttgtaagttggattcctaggtattttattctctttgaagcaattgtgaatgggagttcactcatgatttggctctctgtttgtcacagactggcaaattggataaagagtcaagacccatcagtgcgctgtattcaggaaacgcatctcatgtgcagagacaaacataggctcaagataaaaggatggaggaagatctgccaagcagatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacatttttttcagcaccacaccacacttattccaaaattgaccacatacatggaagtaaagctctcctcagcaaatgtaaaagatcagaaattataacaaactatctctcagaccacagtgcaatcaaactagaactcaggattaagaaactcactcaaaactgctcaaatacatggaaactgaacaacttgctcctgaatgactactgggtacataacgaaatgaaggcagaaataaagatgttctttgaaaccaacgagaacaaagacacaacataccagaatctctgggacacattcaaaacagtgtgtagagggaaatttatagcactaaatgcccacaagagaaagcaggaaagatccaaaattgacaccctagcatcacaattaaaagaactagaaaagcaagagcaaacacattcaaaagctagcagaaggcaagaaataactaaaatcagagcagaactgaaggaaatggagacacaaaaaatccttcaaaaaattaattaatccaggagctggttttttgaaaggatcaacaaaattgatagacctctagcaagactaataaagaagaaaagagagaagaagcaaatagacgcaataaaaaatgataaaggggatatcactaccgatcccacagaaatacaaactaccatcagagaatactacaaacacctctatgcaaataaactagaaaatctagaagaaatggataaattccttgacacatacactctcccagactaaaccaggaagaagttgactctctgaatagaccaataacaggatctgaaattgtggcaataatcaatagcttaccaacgaaaaagagtccaggaccagatggattcacagccgaattctaccagaggtacaaggaggaactggtaccattccttctgaaactattccaatcaatagaaaaacagggaatcctccctaactcaatttatgaggcccgcatcatcctgataccaaagccaggcagagacacaaccaaaaaagagaattttagaccaatatccttgatgaacattgatgcaaaaatcctcaataaaatactggcaaactgaatccagcagcacatcaaaaagcttatccaccatgatcaagtgggctccatccctggatgcaaggctggttcaatatatgcaaatcaataaatgtaatccagcatatagacagaaccaaagacaaaaaccacataattatctcaatagatgcagaaaaggcctttgacaaaattcaacaacccttcatgctaaaaactctcaataaattaggtagtgatgggacgtatctcaaaataataagagctatttatgacgaacccactgccaatatcatactgaatgggcaaaatctggaagcattccctttgaaaactggcacaagacagggatgccctctctgaccactcctattcaacatagtgttggaagttctggtcaaggcaataaggcaggagaaggaaagaaagggtattcaattaggaaaagaggaactcaaattgtccctgtttgcagatgacatgattgtatatctacaaaaccccattgtctcagcccaaaatctccttaagctgataagcaacttcagcaaagtctcaggatacaaaatcaatgtacaaaaatcacaagcattcttatacaccaataacagacaaacagaaagccaaatcatcagttattttgaaatatacgattcaatattgttagtattagtcaccctactgtacaatagaacagcaacatttattccttctatccaactataatttttacgcattgggcaatctcccacacaagccagatttttaagaaaactatcgcaagaacaaaaaaccaaacaccgcatattctcagtcatatgtaggaattgaacaatgagatcacatggacacaggaagggtaatatcacactctggggactgttgtggggtggggggacgggggagggatagcatcgggagatatacctaatgctagatgacgagttagtgggtgcagcacaccagtatggcacatgtatacatatgtaactaacctgcacaatgtgcacatgtaccctaaaacttaaagtataataaaaaaaaataaaaataaaaaaataaagataaaaattaccttatagatcaggagaaaaaaaataaaaataaaaatggaactctggtaatatgttaaaaaaaaaaaaaaaaagaaagtcttgctccttcccttcacctacaccgggaatgagctcatctaacttggtgacttcaagaagttcaagttgcaaggagtccaccaccacaggaatctctaaatgcctttacaatccttaagttcagcaggattctttggagcgattcttaaatttaggcaatgttgttaggcgtggtcgtgtctgtctctgccattattttagctttcattacatacactccaaggaagagaagaggcaaataaggttcacagataggtcaatctttgataatatgatgaattgattaccttctggaagagggcacattgtataagaaacataacctggagttggaaccaaaattctaggagtcaaggctttactgacctgtgatcccacatgtcacccactgggtctatttacctgaaattcccatgtgaaattcccatgcttcattatctgtcttctccactagactatgaattccacaatgacaagtgctatgcctgttttgctcagcattgattccccccggccccatacagcatacccagctcttctttagaatcctaggtttccatgaaacacagttcaaccaagccatgaaaggatttgcccagaaattgtttgagattactttaaccaattgtataactttgggcaagaagtttatttttttctgcttgttcttcttcctaaaaaataggcaattgctatgggcttgatccatttcaaagggttgtggtgggattccaatgatccagccactgaataaatggtagatatccaaacatgccatggaaatgaacagtcttgcttccccatgaatcttttatctggtatgcctaatagaaaacatagcattcaccaaataactggatccaggatcctttaaggtccattccaactgtgagagtctacaattccataagtctaacaatcactttaatacatttggaatattctttatatttgcttagatatccccatttaagcataaagaatacatttcttaaaaatgtttatttggaccaactaaaatctatctaatgtaagcttctctcaatgaatttttagcatatcctctaacccacagctaaactatctaggctgttactattgaacactttattaactctaaacttcatatatataataatgactgacatagattggctgtttgtcccctccaaatctcatgttgaaatgtgattctcaatgttggaggtagggcctggggggaggtgattgggtcatgggggcagatacctcatgaatagtttagcaccattcgtttggtcataagtgatttcttgctattagtttacgtgagatctggttgtttaaaacagtgtggcacctcccccacttcttgctcctactctctctatgtgatgcgctgactccccttcaccttccaccatgattgaaagctttctgaggccctcaccacaagagatgctggcaccatgcttcctgtataacctgcagaaccatgagccaattaaacctctcttctttgtaaattatccagtctcagatattactttatagtaacacaagaatggcctaatacaataacagactttaattgatgtatcatgatccacaaaatatttctatttagttctctagtacccattattatcattcccattttacagttgaggaaaataagagtattatatccaatgctagtttcaggaagaggcagtatcagacatttactttcaaaacatcatcactgttatgtgtatagattaaatttagaaagtccacttttctctaccacttcctgggctaaagtttttattggattctgtattagtttcgtattgctgctgtaacaaattactgcaaactcaatggcttacttaatacaacaaatttgtattatcttacaattctggaggtcagaagtctcaaatgagtcaccagggctgtgttcattctggagactctaggagaaaatcttagaggctgcctgcattccttgcttgtggctccttcctccatttcaaagtcagtagcatagcatcttatctcctttctgacctcctgctttcctcttataaagattcttgtattgtgcctaccagatagttcaggataataccccatctcaagatcctgaactcacattcgcaaagctcattttgccatgtcagggaacatattcatggattctggaaacaggaatgtggacatctttggtggggtcaggatttagggcttttatcaatcttctgcaggtttatcttacaaactcaatttcactggccccaaatgagctgctcaaaaactggcacacccaagactgcagcatggtctcatggaaagaactcatcttaagaatacaaaaggtgggttttaaacttatttattttctactttggtgaccttggtattgtcatttatctcttttaagttttcattttctcttcagaaaaaaaaaaattaaacagggtatcctaattcacctgaacttaacaaatagttaagttattaaaaacctactatgccagcctatgttaggtgacctccacgtttggggtaaatgcagagttgactctgcaaggtgtttgtgttccaatttttgtgaataaggaaactgatttgtagagaggttaggaaatttgcttatgataacatggcagtggaagagccaggaaatggacccaggtctgtcccattccaaagcccctacttttctcataattcctggttgtcttcctcaaggacccaataagactatgtaacaatattttcacactgaaagtgctacttggatgtaaggagttactattactattaccattactgcaggtaagcgacttccttgtagcatctctatgcttgtgcctgccagcattataactgtatgtgcatttgcatgtttccaaaaataacattattcaaagagtaaaggctgtcttcttatatcattaagttaatgtttttcatttaaagtggacttgagaaagctttccaaatatgttattaaataactcgaacttcttaaccacagaaatatcccctgggaaacccttagccctgggcagctaccattaggactaggatggagaaaaatgacaccaggcatccaaagggtttcttcaagcatgttctgtacgtgctccctgatttttctcccctgaatcactttctttgtttctgcagatggtaatctccctctactggggctatgtggaccaacttgctccaatccacgcatatgttcaggttgactccttgctggcttttaatgccccttgagcaatcaaaacttctctatttcaattaacattgcttttgatgtttaggaaaaaatattccatcatctataatgtatcacctcaagacctaatattaatatttgcttaattttttcctccctaaaacagaacaccattcagacagcactagtgatggccaaacactattgctttatgagaacagaaaggagataggctatgcataatggggaagaaatgcagacctaaatgataagcaatggaaatgtttatctacttatagtatccccatattttattttcatgtatatgtcctgcagctcattttgcttcctctgcctggaatgcctttgttcacttctgcctgctgaaccccaattcatgctttatgacttacatcaataattcacttgtggtttcttatctaataacttataacattgatacaattttaatatctatatttattttatcctgtgagcaagcattaagtttgtggatcaaagaccaggcttattactacttacagaaacaactgtactagttccctatgacatgctgccccttagagcaaagtgatgagggcagatgtcatgctgtatgtacagagagaggaatttcaaaattcaaaattatgaatctgggaatttatggaaccactggagagctgcccctctttttttgagagagagagtcataagcctatcttatttaaaatcatcaaatcctctctggaaatgacatctaagttattagaaccttttgggatgtatacaaatgactccttgttttatcctcctttgagactcgaatccttacctctagtgagataacctctcactccctctttaaggcattttactatcctaaattttctattcagtcattatttaacccaagttgccaatcacttttgttcataaagtatacgttcatgcagaaacatgaaaatgttcacactgcctcctcaaaattataattcccatatcctccaattatagtaagtcattgtccctcagtgtcactactgtatgacacttgtcattctcacaaccactattgatctgcctaggactggtctctatccagcccaaacgtggttcctatgtttgcacacaatgaatggtcagtaaagatttttcaaataaatggataagcaagcattcatcacccaattttattatgtaaggcagcatgctataaaaatttaaaggccaagtagttttcaaactgttatctctgacaacatctcatttgaggtacgtccactcatctcatttttatccatggagaaattgatacttcaagagttaaagagacattcccaagttcacacagccagtcaatgatgctgctaagatcggaacccgtatctgtctagccttgcaggccatactcttagctatgactctctgatgtcttactttgtggcatcacagatgcctttctacttacattggtaggtttcccaagaaacaattcaatgctttaaatgtgattgggttccctagaggcagtctgagatggagattcttgtgcaaatgatttattaaagggtatattcccaggagaaagggagtgtgaggaccaggacaggcaaggggaaaaaactacagatgtggtctcaactggagactagcttcagcctaatcctgcagcaagtactggagcgagatgaattgcctcatcttcaggcaagaggccagccttctgcagacccaccttaatcactcatttcctggagtatatctccagggagagaggaggcataacctctttggtgccaacggcatttcccacaggaagaggatagctctgagctgttagcaacaaacactcacatcaccaatagatgggttgttggcctcataaaggggacctaggtgggacaccatgagcacccttcctggaagagctagactgctgtgattggcaccccattgtgaatggggcgatagcattttggctgcaactggctgtgtgctccagttgccaagtaagcattggctgtctttcgttttggtcagcacagcctccagctttaagctaaactggttgttattgcaaaagatgctctagctctgaatcttgctgaaaatattgggccactttgggctcagattgtcaaaatacacacgtcgtacctctagaagaggtgttcaaagagaggcttcacacaaggcttcagtgccctgggaacccactggagcagacagctcctgggaacatgttccatgggcaggaaatggcaattaagcacctgttaacccgggtagtattaactgtccttgttcagctcaataaacaatttttagtcatctgtttagctttcttatttaaacacctgtgtgtcaggcagcttttagttcatttataaactaaagaatcatcagctcaaaacctaaaatttaaattgcatacaaatcattcatatttattgaattaatattcagtgtcagccatctcacccttttgaaatgtttttatatttaaaaacttctttgagataggtattgttatctattttggcagatgaggaagctaagggacagagatgtgaaacagtctgatatcatatagctaatgaacccaaatttaaaatcggatctatttttaaaaaatatatatccatatatgtcaaattctcaagtactaaaaggtatattttcattatgctttcattagatcttaggttagaacttatttgactgtctccagaagtctgtctggtagtgtctaataactttaaaggcaagaaagatccagaatattttaggtctttggcttagtctccatacaacatccaaggagatctttttaaaactttattctgatcctgtcacctcatgctgacaactcttccttcaggttccccactgcactcaggataaaatccagactatccacacagcctggctggtcattgtcagtacaatggtttacattctggctgcttctccagccccatttcatgtcatctccatttcattctctccagtccagccacacttgtcttcttccccatactccaaccattccttctccctgtaccacttttccttttaatctttgataaattcaataaattcaccccctaccttcatatgccacttcctcagggaggcttttaatgaactcccaaaattgtttaggtgctctaaacaattctcacagaaaccgtgtttctttcttagaatttatcagtttgttgtttcagactagcacaatcttctgatgaatgctttatttctatcactggactgtacacttcagcagagcaggaatcatatttcttgtgactactttcatattgccagcacctatagtacctagcacacagtaggcattattgaatggatgaatgaacatacttccccattccatcttctctattcccttataaccatattatttaagcctgttcttttttctccagttgattaatagataatggctaaaataacatcatgggacaggctggcatggcatgatacacaactagaaataacacagagcctttttctccaccaagcaggaagggtgaactgaccaactccctaagaccttagatcccagtacactacagctactacataggagttcctttctatctttgacaaattcaaagcaggagacttcagatccactgggaggaagctacaggcagaaaaaaaaaaaagccaaggtattggcaccatcttgcattcattaaataatcatggggaagtttcttaacctatcacacccccagttagctcatctgaaacatgaaatcatggtgctgaaagttatatgcatgctagataaaggatgatcatgactagaaacataggttaggctaggaagatgtggcctaggagatttcacactgccttctgccgaatcctgaggttttcaggtgcttaagtgtccactggtgggagagaaggaggtgatagagcagggatcaagtaggcctgttctggagtccctgctgctatttcaatataagcaaattcactttaattttatctatatatcaaggtcttaaagaatattttatttggaaaaatgttttagctgtttaaaaatacgttgaaaaacaacttatttgatcttgcattctcatttcacagaagaagaaatcaagcctagtgaaatctcacacagctagtcaattgagtcctgtgactcaggacttatttttatactgtttcccccctcctcatatgctttggttttgtagggtttttttttttttcaaagcttatggatcactatgcaaagtttcctctgctattctaactcagctcaatgaatcagcagagctggcttctagtcctgggcatataaccaactagctatatgctctggtctaaatgtttgtgtcctcccaaaattcatatgttaaaaccctaatcatcaatgtgatggtatctggagttggggcctttgggaggtatttggctttgtcctcacgaatgggattagtgcccttataaaagaggccttagagagtgtgtcttttcaaccatatgaggacatggctagcaggtgtcatctgagtcatcagacatctaatctgccagaaccttgatcttggatttactcacctctaaaactgtgagaaataagtttctgctttttgtaagctacccagtttctggtattttgtcatagtcgcttgaacaaagacaacatttaactttaagtaagttccaactattctcagcccaagttccctatatgaaaagtaaagataataattcctggcctgccctgtggagagtgagtgtgaggaacagataacaacaaaatgcaaaattgctttgactactataaaatgtcatctctctatccttgaggcatataaaaagtctatagtcagcatgtaataaatgttgaaggaagaaaaataaaaggaagtagggagggaagaaagagataggcagaaaagtttacttctatttctgtctcatcgatagtaagtttctaatctcataaaaacagaaacactcataaaatgcaattgctgtgtctctctgtgatgaagggagactcaaaatctcccactccttggtctcgtgggtaccagattccacaggactagttccagccctgaaatgctttgcttcacagtctctggctgaatgaatggaacactcaagccctgtttcaatgaaacctaaaatgtgttttgcccctagaccttttccttttatctttcaagacccatgtaatgtaatggaaattgatgaagtgtggaataaattccactccttccccacatctccttgtccattgtacctattaacttagaggaatttagcctgcaagggagtaaatgttggtgtagaaagggataggacgttgcagttctttgaaagcaggggataggacgatgaataatgttgaagttctttagccaccaaagccacagcctgtgagaaatgcatacatgtatttcttgtcattgagtgaggcttgtctgaagatgccactcactttcacatctcaagtacactgccaatgcctcccatgcccagatgcttccagtggcccaaactccccccatatctctgagtcttcctgggtgtgttcatctgattgtcctattaactcaacatatcaaaaactgaatcaattacttctccttaccccctacaaataatcacatccaaccaacatgttactagtcatgtcaccaccatttttcttgtcattcaaactataatcctgaaacctgtttttaacttctctccatcactgtgcctccatttccagtcaattaagaaattttctttcttacattatgatcccattctctctcctaggtgcattttctacctagtactgttgctggaaattttacctcctactctattatctcccatatgaactgttacagtagcataatgaataatgtttattgagataaaggtttttcagtgccacaactttcaatattttaaaccaaaacattactattttctggaggtaagggggagggtgctcggtgcattgtaggacattcaataatgtccctagcttctacctactagatgccagtagcaacctcccctcccctggggtgacaaccaaaaatgtttccatatattgtcaaatgtcccctcgatggcaaagtcatgctagttaagcaccactactttaaaccaagcatgtcaggtatcatgcatgccaccacttatttttcctgagattatgggataaagctatggccaatccagatattttatcctttagagacaacatgcgggctcacagtctttctcaacatagcatagctagcacctggtataaactcattggaatgttcagaaccctatttacctgttcataatgtagtctcaccattcattaacatcagaaagtgtttctatttctgtatccccagtgcctgacaccctgcctggcatttaagagatccttatgatatattttctgaaagagtgaatggatgaatttatcactcctcactcccctccacaatcgagggtcatgaaattccacaggtcaaaagttctgtgtcttctgcaattgttcactgcacaagggtgccctatctccagagagcacaactcacatcagagacaccatagcattatacatctctcataaagataaacttctgcctaatggaagaagtgtggaaggtgtgaattttttctaatttgtacaagagtgtttgcaaaaagtgaactcgtggagaccctgcaaacttcctactgtgacatcagaggttttgttacttaatcctactttacagaacaagcataaagctcagctctacagcctgatatcgacagccttctgagacctggctctacctaccattctatgcttctttcttaatattttctttcacgaaattttagttccactttgggggtcactgagcacaccttgttttccctctataattttgttgacccatttctcactgcctagaatgctcttaccagcaactgcatatacttatcggcttacttttaagacatagaaaatcaacctgttttagaggtcttgtgaaacacatatttcatatgttattcatttaatcatgtaggcaggattatctccaatttaccatgaggaaaccaagtttcaaagatttgcctgaatgaggcaaaggtaggtcacagtttgagactctcaacagcatatgcctcttcatagttacatctctttttccttccttcctgtctctctgttcagtcctgggtgggaagggagaggtgaatctctcttaaaccagtcttccttgcaggaaaaaaaatgtgactggctaacaggagctcttgggcatggactggtagtctttgttatatccaaccacagcatagttttctatggaagaaaaggaaagagttttatttttaggccaatttttattcaccacatagccagcactatttagttaaaaacgttagagcttaagtcacaaactaaagaacagtctgagttggcagagcagggggcatgaaatgacttctccacaccaacatacaagaaaatcggcagtgggagtccaacttccgaagatcaggatagcaatatgtacatatccacaaaatcaaattcaattttattggcagggtagaaagaaaaaaaggaaaattgaagaaaaaataaatatatgcacttgtaaggaagaggttatgtaggttaatgttgggagcaggcgtggttatagaacgtagaattcaaaagacttgcgttgatttttattttatgcatcttattattcatttttagcatgggaaagaagagtaattcctttaagggcaggcagacttttaatattatcttcatagaactatactagtagaagcaaaatattattagatgagagagctagtgagtcagagatcatctgaatgacttgttaaattttcagatgaggaaattgaagcttcaaaaaggaaaaataaaccacaaaagtcgtatggtaaatgaagggcagagattagaaaccatgctcctggcacctttcacaaaattctttctacatgttcaccctcattcctctgccattttgcgacctccattctataaattaccactgggagttcatcacagaaataaccacagaaaatggggaaacgaaacttggctactctcctctctagaacatttattctgtatgtgagtcagtacaaaaaaaagtttacacttcatttattcatgtagtaattttgaattaagctgcaccacataaattctcctgaaaaatgatgcaattaagcctggactatttgaggaaggacaacaacatgtggctgtaattataatggcaaaacatcttggtagcacgctgacttattagtgcagtaattagtgttggtgcaatgcatactgaatagtccataaaacaaataacgcgatgtaaaattctgaaaaagagtcataattttcaaatgaacaatctttggatattttgcctgtggcatcaaccatttggaccaaattatttcagccaccacatataggaagctctgcctccctcctgagtacagagtattagaaagatcttcaacttctggcaaaatagagaattcttgtataaaatctggaaaatgagagcaaaatgaactctgttagggatgaattatctaaatgctaaaaagtgagtgaggatttgctgtatagtcttggattctggaataggttgcgccaatagcatttattaaaaatcacacagtggatttatccacttcacaatttacacatatttcagaacatcacattttacaccacaaatatgtatacatatatataatttttatttgttaatattaaaaataaatagattctttaaaaccacaaaatgtaaaattatcagtctcataataatagatcttagaattggttagaattttgagacaccacttttactgatctcctaacttcagacagtaatgttttataatttcattttataaataacttagtcccaaaatatctcaataaataaaatcataaaaaaataagagtcaacaatgggtatgtaactgagttcccatccaaattccatctctatttagtacatggatttaccataagacatctccttagatcttagtcacatgtcttttataatcttacccacatattgaaatgttttattcaaaatattggattaaagaggtccagggctaaaacaccagaaaaaatattcttctagacggtctttggctggttctcaacatactctaagcagtatataactcatatacattcagcagcaagtaagacttgtatgttggagcaggtgctgagaaagtggaggaagccaggttagagcagatgtgcagtgatattgcacagtactggcctcttgtttgagtggatccaagagtcagcgagatggtgcccagtgaggtatgaaagctcaggcttcgtcatctctcattttgatatccacggagatcgcaaatctgtgtggatccttaaagtcacgaggatggccctatcataactatttcaaatgggaaattttatgtgacatcgtgtcccagccaaaggcctaggcacccagaaagcaagatttgagaaggggctagcaagcgttaggcagtgcgtgataattctatgagtggtctgggggtcagatcaggatttgaagagatggctagaagtgggattgcacccttaattgtaatgggcaccaggaaaaagttgcttcctagaatgctggatccctggctgcaaaagctgcaaagtatggcatacccactgtgtgccaggtattgttccaagcactgtatatgaattagtatatgcatctttataacaaccataggagcagggtcctgttatcatcttcttcaacagatatataaaaggatgaatagtttacctgaggtagtacagacaaaaataagaaaaatcaggatttgaacgaatgcagttagttctagagtatagtatttatacaatggctgcctcttaaatggaataagataaattctagttcttacatgttggtgcgtgtgaggcttctatgacatggtctgtttgggttgagaataattcagataacaggtgggacttacccggtggttgaaataatcaattccaaaagctgaaatgaactgggaacaacaggggatgaacaagcagattcaatcaaccaatgactagtagattcaagagaagtccacctcatgtcttctgccacatcagtcttatgaggatcttattgatacccaagggtcctttttaatacttctggtctaacaggctactagtaccccaaacaaacacagggtcatgggtttaaaatcctctttttgcccattgctcttggtgagtcattgggcatttcattccccttctctgagcctcaccttcctcatctggaaattggcaataaaaatatttcatataatcacatccaatgttaaataagaaaacatttgtaaagcaggagctctggagccagactgcctgggttagaatgctgagaatagaatttttcagttttgtgacctagggctagagacttaacctctctgctcctcattttcaacttcagtagaatgagaattgtaatagaacctaattcatagggttgtttgaagattacatatgttaatccacataaaatgcttataatgccttataataaataccatattcatggtagctattgtaactatttttgttgctgttgttagcacagtgcttaattgattctctttctttttcctccacttttttccattaaacaagtgagattagtgtctgaaatttgacctcatgttgaatccttgtaaacttactagatacagcagtttgctcattccaaaactattgggtctgatctgtatcactcactttatatactatatatatgtagattacaagatgtgcaggaccacatactgtggcttaatacctagtttgaaaagagaataaaattacttggaggcagcttgtgtgtttggagtctaagttccagctctgccactaagtttctttatgatcctgagaaagttattgacttactctgatccaccttgggaaaaatagtgtctagatttaaagttgcaccatagtcacaatggaatgatttttttttaaatcagtgacaaccaagtgtgaatctgaacactgccatatactagttgtttaatcttaagtaagttacccatcccttctaattctcaatttccttatctgcaagtgattgagaatattatcttcttcaagaggagtacatgagggctaagtgagctaagggccattgaatgtgcttagctatgtatttggctcatggaagggactttcatgccttcctagcttgtccccacctcaaccactgtgcccaactcaggtatacatgtaagtgcacactcatataccaaagtaaacctttatattttgattcaacatcaagtattccttagtctcatttaaaaacgttaggcgcatgtatttttgggagcagagtgacaatgcgattgctctctaggccttgatgcatgcttggactacattcttgggccattttttctataagcgatgaccttgttcagcacagtatcttctagtctctttcaactctaatcagaaagcattacctttagactactaagcatctaccacacaaataactattatttttcaaaacattatcctcattagttttcaagtagtcccctagtttctgggtaggcttgatgcaaaaataacatgagatccaaacaaaatcctctgtgaagacctctctgaatatgccagcagaattaaccctctctccattctcctattatgcctcctttcccctccctccctcctgcattgtcaaatagacttgtctgtcttgggtcggcctcactctctgaactgtgagttccttgaaggtagcaggggctgaatctttttatttttgtatccccaacatttataactaagtccaatacctcatacagaataggtgcttaaatattaaataaatgaatagacaaatataaaaattcttccctccttctagtccctcctgcattgtgaacatgaatgtgtagccttgaccttatacagattcaccacaagaatatggccataatgatttaggtagggaattattggaagacacattttataactcttgccataattaatgtgacaagaaataataattgacttagtaatgcaatcaaatcagaatgtatttgatttgatctgtcaagttggtattcatatctctaatccttctagtcagagctttcaacacctaattatttctgaaagcagtgaaggcaggcacatttgatgtcaagcttggtttcaagaaatgaggaaatgttgcaccctcgattcattctgtaaagctggagaaggtgggggagatatgtctcttactctgtgtttttgctcctcatatgcatacactctacccactgctgaggtgtttactaagccttggggtcttaagcccagttctttaaaagaacagtcttttgagatgtggaagttattcctcaatgtatttcacataacacccataaagacagaaagatgtgtctcagaatgactaaaagtatatgttgaaactgaatcttgtttgaagtatacaaaatcaagatacaagatcaacagagtaagtttctgtctgataaaacgttaatatgattaatgcctggcaaacttattccaaccttgatttgggtttttgtcactgattctctccagaatttctagtttataatgaaatgcattttgcattagtcgatttgccacattgcaaagctagaaatcttttgatgtttatttcatgactgcctttcaagtatattgtaagctccttgaaggcagaggccaggtcttttaatccatgcattcccaggaagtagcccagtacctggtgtacagattctttaaaaaaatatgtaatgagcaatgaataactgaacattttgcctttcatttctttgccaataaagcaaggacaggggagattggagcacaaggaaaatttgggagtgatggaaataatattatataatattatatagtatgtaatagtactatgtagtattttactgaataacattatataatattatttccatcactaccaagttattatataacatataatataataatataaagtggtataattatgatataattaacactatactattatacgtaatatatattagtaaaatatttatgaatatattattttatttatatataaaaatagaacatagtacagaaagattttgaggggattaaaagaaatataatacatgtaaatcctctagcactgttctcacctagtttctaaccgtatgacatgttagctcaacaagaaataaatagataaattgaggatttcatttgtgttttctgaaagctaatgaaaaataaaagcaatcaaccaaacttttgcacatcctttccctccaaagcttcagttttctttttttggaggtgagctggaaccacatgtacctgactttcttcatcctatagctgatatgagttttatgttgtgggagggcagtttgcttaggtagtaatctttaaaatcgcttaccaaatacttctagttttccttccaagcacatggattttacttccccacccttttgaagttagaaatggcttcctttgtgcaggcaataggagcataagtaatatgtggcccctgtggaaagaagcttcgagatccaatgagactgagccatgacatattttcctgttgcagccactgtagaaacacacatccaggtacagctttcttcagcttggatctctcagtgactgtggtgagcaaacgtctgatgtcaacatgttttggaaatgtccgttgggtgtgaaatcaatatttggtttcgctcacttgagatttgaagattgtttgttattgcagcagaacctagcctaccctaattgacacacgtgttaccttgctgagatccaacgcacagtggataatcaatcaaaatctaatgaattgaactaatttccttaccaatacctagacacacacaaggaagatccaaagatgaatttgcctatctttgggttaaagcaaagttgcctcccctccaactgcttctgaagatttgttggacaaatgctcctaattttttgatctccatatttctctgccttccttgggagaacaagggagatattttccttctaattttctatatctcattgagaagattagtttgactaatgatacactagtgtagaagagaccacaaagaaaagatttctcaccctcttattcaataatttatcattgaatgacaccactggccttgtattccaagaaaaaccatgggagagtaaaagttaaaaactggaacctaaaacatggtcttcaaatgaaagtgacatttcttatgatcaaaaggtaaaaacaactatatttatacaaagctaattcaacagttttcctacaaaacaaatgcctgttagaaagatcatacacaatgcccaaatcaaacagaataattgccttttctagccacatggcataggaagaagtgagtgagaggttgtaataagcccgacctttacacccctctctgctacactcctaggtgaacctactccacctatgtcctaagctgagaaaattggaattcctctgcttgtctctttattggttctctgctcaccaactgtcaggttttcagcaacaaaaggcacgggcagagctaggaattctactgtcctccagcttctctacctgccagtcttgagcccatatgaagagtttatatgaagcatgaggcttccagagacggacaacatccatctcttctggacatggcctcgtgttcttcaaaagagaaaccctaagacagctattccttcagttttcatagtttcccttttcttcatatctagctccccagcccttttatccccttttcctctctacaagcagtgccaaaacatttcaattgaaatattccattccattacatcccatctcattattcataatccatgccagatggcatgtcccaagttttgtttctgaagatagaaccaccatcccatatattgcacagcactgaaacagacactcaattaacgttctttcaacgaatgagtaatataatctatctttcaacgaatgaataatataatcaaagtatatgagttccaaatgtaaactccctgagggcaggagcaatgacttacttgcctttatactcccaacagttagcattctgattgccatatagtaggcacttagaaaacagttgcatggttaatagcatggggtttggcataatattcttgattctacttttagtttcatcacttactacctgagtgactcagaaaaattattcaacctattttagactgttttcttgttagcaaaataagactgttatgatgattaaatgagataatgtgtactaaggacttagcatagaatatgctctcaataaagactattgagtttcacctcaatagcacagtgtccctatctttttatttatattgtccaagcttgcaacatttcggcattttcaaaggcatatgcacctgcaaccagcaattaagatactaatgtgatccacggtgtcaaattcttaatcacaagtagctatgggttagttctttctccttcaagctggtgaatttatctaaaaatttatgtctattacacaaaagaaggccaaatatccagaggatttgattttaaaacccacgcctggagaatggcgggaaaaggatgcgtgtcaggaatacatcacacctgattgcctcaagcatgcatgtgtgccagacatgcctacacaactggtttcatcttttaaggaaaagaaaaataagtcacagcattccccaggaagattcagcatcatcattagtggtatgaataatttatcagcagctcccacatccagataatgacacttttgttgtctgctcaaagagcagagaggctgttcaacaacaacaaaattagttcccccaaaataaaaccatctttttcacccttgaatttgccttatctgaaaattgcagatgtatcaaggcaccagttaagccaaagaatacagaagagacttctgtttaaaacaaaaaaaaaaaaagagagagagagagagaatagaataagggaaaagaatctaaaacaaattatttaatacattttaaaggatcatttcttttcccttgttttcttaaaatcatccaacaccattgcatcttggatatgtttctcaagtacaaaactgtttctgaaaatgataaaagactcatttccatgtagcataaggatgcttataagaataatgcagtttctaatctttaaagctccaacttcagcattaggtctgctgtggccaaacgtaaaaaagcaccagtgtgcaggcaccaagcccgacttcttggaagaccagctaaaatagtgaggggcagatgcatgccagcatggaaatcaaagccatacctggaagctaagcagagttggggttgttctttcagaattatttttcatgtgtttgaaacggaaacttttcagaaggctggaagcgttcctttaagtcacttgacctcttaaacacaaaactcttttcttcccccttagagaaaaaggggggctgaagggttggaaagacttttgaaaagccatagaaggctttacaagtaactgtcctggagcaatccctgcggaggaaaagaaccttaccactcaggaaatctgtctagcccgctaccttgccccactcagctgcccttcgtcacagatgttaccgattttataagatagcaattccctgctcccaaaacagattccaagtgagaaaataggaaaagtaattggttgctattagatacacattctgaagtagaaagaaatgtgggtagcgaggaatttctggcctggattaggggttccatggtaattaaaccataatgacaaaggagattcccaaaaacttacatgaaaacacaaatgggcaatgtgcttctttcaaatcatctaaggaaaataggctattctttctataaaaggattctttttcccaggaatagactattgttactgaatgtcactgatgcaacttcaattgtacacgtatttgttgagaagacatgatgtgacaggccttatgctagatgtggggtgcactgacgtaaaggacctcccttacctagccatactgcactcataatttcccagtttttaattatattttaggaggtgctatgatacattttaaggaggagtgaataatcctataaggaatactccttcccatgtagaatttattgccttgaagcattttctgggatcctactgaatcctttggattaggttgtaacagaagttcattactaaattgtccttcaggcttaaacaatagagagcttgagtttgtttgttttattttctcttaaatagctttattaagataaatttgcataccataaaattccactttttataatgtaaaatttaccaaattttaatatattcacaggtatatcccaaaaagaaacccatatggatgggcaaacacccttcattccccagctacccttacccccaccactatgcctatgcctcagcatgcagtcccaagcaaccattaatctttctcgtctctattctggatatcttatagaaattgaattatatgtgtttttgtgactagcttgagcttgagttttaaaactttcatgtaaccagacaagaatccaggagttctgaactgaacttccatttccttatttgtgggaaaaaaaaatacctcctcggacagttgtaagaagtaaataaaataatactacattaaagcaggtaacacaatgcctgtcgcacagatattgccaaataaaatttggcttgatttctgctatcacaaatctttatgccagaagcactccttgcagagtgtctctaaaaactgtctatttgaaaaatgttgaagaaacaggcagaaaaataaaatacatccaactcctaatctgaccacttaaaatttataaaataactcttctagagataacaattactaacagagcaacgtgtatgtatctaatttttcttatgcttagaataaattgatttatgatatatgcacacagatacaagaacatgagacctctatgcctacaagggctatatagtacagatagcaatagaaaatgtaaacatttttaaaaatagaaatataaaattaagtgctgaattgtatggtacaagcaaaaggagcaaaattttgtagactgtatatcattcacagcatggcttttgctttaaaaatagcagcagtttgagttccttgtatattctggatattagttccccattggcactattcacaatagcaaagatatggaatcatcttaaatgttcatcaacagattattagataaagaaaatactaatactattcagccataaaaaataatgaaaccatttctttttttttttttttttttttgagacggagtctcgctctgtcgcccaggctggagttcagtggcgcgatctcggctcactgcaagctccgcctcctgggttcacgccattctcctgcctcagcctcccaagtagctgggactacaggcgcccgccactacgcccggctaattttttgtatttttagtagagtcggggtttcaccgttttagccgggatggtctcgatctcctgacctcgtgatccgcccgcctcggcctcccaaagtgctgggattacaggcgtgagccaccgcgcccggcccgaaaccatttcttttgcagcaacatgaatggaagtagaggccattatcctaagtgaaataactcataaacagatcaaatactgcataatgtcacttacaagtgggcactaaataatgtgtagacatggacagagtgtgaaatcatacacattggagactctgaagggtgggaaggtgggaagtgggtgaaggatgagaaattgaataattggtacaatgtacattatttgggtgatggttacactaaaagctgagaggtcaccactatgcaatatattcatgtaacaattcatgcacttgtaccccttaaatttatacaaatttttaaaaagaacactgaaataaaaggcaatagtaaatattaaaagtacaaaatttaattaaggtagaaagattaaaaggagtatgtcacacagacttctaattctaaaagggtttaatacagcttaatagagagtcttccaaatgtttttggttcatggcacatttagtatcagagtaatttttttcacagcccaaagaaatacttaataattttattatgtagttgggtaaaaacaaattaacaagtatttgtatcctaactactgagtaactttttgaaaaagtttttgaaaaaaaagttacatataaagaaaaatattttatttcatttttacgtaaccaaaattacttatgaataggaagcatgtacctcttggacactccatataacctctcaactttggaaaaagactgcgctatcaccttcactccctgtttcacattgattttcacgttatgttaggttttgtttcttttttttaacatactgtttttagagtcattttaggttcacagcaaaattgagcagaaagtacagagagttctcacgtaccccgttgcccacacacacttgttgcttggtttttaataaaaatcctagctatgcaaagatgtgacctcattgaaaggaatatattgtgatttggtgttaaaattctaaactatctcgaggtggtagttgccatgctctctgaaagatgtgaagcatcattgtgtttttcttgaaatttagaaaaatgcctttctgaggaggctgcagcaccctgggttgcctcagcacacaatttgggaaatgatggcttggagtatttaattctagaatggcattctaaccccagaagtctatgatttagcaaaataccccaatactttaaggtatctaaagatgatgaaatgacaaaattgaaagaacctgggttgctagagcactatctggaagattctatgagttcataggctatctacattaaattgttaaattattgagaagtaaacttatttaggttaacccattgatatcatggaattgttagtattagttacctcccctaataatttttatataagattctacatatatagcccctgttttctctctaatatcttctttcaccatttcccaaaatgtaatgggtactctatatcctatactaaagctagaataagttatttgttgtttctcaaacactttactcttttccttaacagttataatctcccttctcttcccagctaagcccttcttattctctgaagctcaactcgggatgtcacatcctataagatcttgcttaacaactcttggataggtgagctttctctcataacatctttctagcacttaccttctccattctcctgaattgcttgtattcaggctctcatcctcacatctgtatccagcttttcccttagctgaccacaaggccaatattatgttacctctaggcagaactcatggataataactgtgtacctgaatcctaaattcaaaatactaaaaccccaaggttctttgttgcatcagtaacaaccacaacaataactaatatttctgagtgtgctattcactgtgctgagcactatatacatatttaatcatgaaataaaatttatcatagaatttagttctatgataaaaattttccatagaatttagttctttgaaataaaaattatcatcttcctcttatacttaagacaaaatgagacataggataatgaagtgattgtccaaaatcctagagacatccaacatacaaaaaataggaagaaactgttccttctccccaacatgactagaaaccctctttttctgcctaaaacttactggagcatatcaaccccttgatggttatcccatgtatttagggggataagtttcccttttggggttcccaaatttctatactactttcaaacttcacagggaccacagttattttttcttcactactgtattcttcctgggagaacactcagtaaattcttgctaaataaatgaattaatgatagtgagaattccactggcagcagggaacatcacaagtttgggattacccattatagaatgacaactgaaactctttttttcctgcgtattagtcactggaggaaaggaagctgaaaaataatcagataaaagcaatcaaagaaacagtgaacatacttgcaagctgtgatggataaacggtatggacttcaggtaattctggaagaataaataatgctattgtctctaaagtacacagtaaattacataggctatgcaaggcaagagttgaatttctagataaacaaacagttttaagttctgattatgaataattcagggtggtcaggtaacagcaaggagacatgcctgcaatttaacaaagtgttatcagatgagaggcatctccataaagagtgtggcttcttctcttgagcaggtcttaaatgaatgatggagtgaaagcattaagatttttcatcttggggagtacagtgagaaggtgtgagtgaattatgcatgaccttttattctgtaaaatgtgaagtgtattatgtataacttctagctgccctccagaaattatcttaacgtggagcattttggacacccctacaaagatgtgcctcttaacctcattctcaagagcccattggtgaagaaagtttgacactaatgccacaaagtatatatcaaagggacttcatgcctgggatccaggaattttcacttttgaacttctgcaacttaatttttcacccaagtccttatctctgttccatctttatctgttctacattctctaaacttgtttttaagccttcttaaaaaccactttattgagatatgattgacatacaaaaatctatacatactcaatgtatataatttgggtttggaaataagtagacatctgtgaagccatcactataatctatgccataaacttatctatcacctccaaaagttttctgttgccttcttatttattttttataagaacacttaagatccatcttcttggaaaatttttaagtatacaatacagttttgttaactataggcactattctgtacatgagatctctaggacttatcactaaactttgttttgacagtcttctaaccttgtgcttaatgtatttcatataggtgactgtcagtaacaggagtcctgaatcagatatgagcagaaatcatggattaggaaagtgtggatgaaatcatgttgaagaacacacaagcagaatactgcccaggagtagcactgggaactcactgggccatgaaaaaaaggaggaaggctcaaggaactgctcagttttctgtagggttctggcttccatgaataatacagagccagggtggaatgtaagattcaaaaattcaaagcagatggtaggtcgggttcctgggacaccacgtttgtaaaaacactgtgttttgtttcctacaggcattggactctgagcatgtagcaacggactttgcaggcatcatccactggtgcagtgggagctcctaatgtattacttatcttagctcttgttgtatttagagcctaggtacaactcaacttgaaaaagataaatcactattgttggtacttggatgaaataagattggtggtcattgttgagatatcactcaaggtatactcttcattgaggagctccaccctcaggggaagctaacaaataagattttaatagaacaaatgtatgaggaatgattaacactttaaaagcaagatttgcaacatgtatattatgatccctttgccttagcatgggtttttccacgtttgacaagaaaatatgttcaggagagtcattccttagaacaaaaatgaaggactaggaagagtgagacaatgaaagaagaaaaagcatactgtaagtacaatatcaagattcccactgtgagaaatggggaatcaactttgctagaacttcccaagaagtatacaaaatgctaccctaaattttctatccaaaagtcatggggacatttataatgacatcagccaacatcaagcctttggtcaagggttgctcttaggaatgctcgatcccctacactgctgaacatcatgtgtgcacaggccaagaaagcacctgtgagcttcctagtgttggttaaagaaaagcaagctgggcagcacacttaaggtgagatgctgtcaatgtaaaatgagcctaattgttagaatgaaccatcccagccacaaataaaatgagagactggtagggggaacttgacacggaccccagaagcattgggtacaacccttcccattaacacaataattagctccttagtatctaacctaaggacttaaggtaaaaagtgaataaaaatgaaaaatgtgattactctaacattaacaatagaaagcaactgtaacagacttagaagttaaatcaggagaaaagttacatgcattgtgataaatctctatattggagtattacataattattaaaatgacgtttctgaaaggttggtaagaatatggggaaatgttcctagtgtaatatgaagttgggaaaaaatgataaaaaattatatacacagaattatcacaccgtataaaagtaatcacgtatagaaaagtatccccaaaataacaaaatataaaagtagttatattggttcttaggaccataggtaaaaacttttctctacttttccataggaactatgagtagaaatcatagtggttctatcaactacattgtacatggctattaatcctgtcatctagagtcttgatcctcatagatgatatcaaagtctgtggtgcttcccactcattatatatcctaagtgcctattctcatcttaatatggttggggcaactgtctttattgcactcctatctcatgcctcttttcctaagccctccccatataaaattgtttcttgctcctcttcggccctttgggaaacacttaactccgtttttactcccaactattcttcctacttacttatcaaatagcttttcctaatctgagccctgcccctgcctttcctgtctgaggtaggtgattcttctgtctagtcccataagacctgatactcatcataccttagcactggtgatgctgttttgtgttatgtatgtatgtttcttgtaccttattcctaactaaaagccccgtgacatgcattatctcatttaaccatcacgatttctttatcaaataggtattatcatgaactttgttttgtagaagcatagagaactttaataacctgcttaaggtctaatacctaacatattgaaggacaatatctaaaccaagatcagaatataggacagttttcacttcaaatccaatttttaaccattgtctcctaatagggacaatgatcaaaacaacataaaacgaaaggtttctgatatttattggctgttttttacatttggctaaaccaatgaatattctttgcattaacataaacaaatctgatcataagtggccaatagttcctgtatttagttctaaattaacaaaatatcatttaagttaaatgtgcaaaaacaacttaagtagtcaataataggagaaaatacctaagtgaattatgtactcgattaagccatcagcaattaaatttatgcggttaaaatgcctacatgatagttctatgtgaaaaaacaagatataaaaatgtatatgcagtgttatattctgaacatgtgctcacacctaccacaagcacatttaaaaaactagaagcaaagaaaccaaactattagcagatttttatagatgctaggattattggcgattttatttttatttttctatatttgttaaatattttacaataaaatatattctttttataattagaaaagtcatcaagctttagtattaattcatttatgtaatttatatatgaatttatgtgcaatatcttggccataaattgagaaagtttaacaagtgggaaaaaatggttacaaaccataggtccaagtttgattattttacctggagcaggatttgaaggaactcatgtttctgggttatagattcataatgaaaggaaagcaaaaaggaaaagtgcctttatatctctttttcagtaaatcctgttcaaaacagagtgtgttgttaagagatacaacgttttctggtagacacaaattagatgctgaatgatgaaaggcacatttttagctgccactgagaacttcagtggagaaactttgagccagaacaggaaaaggttttggaagtgcttatggtctcatcagtggttttcaacaattcgaatgagacatgatgagtaccccagtgatattccagggaggaagtaggtagttaacttttttatgaaaaatatattcataatatatgatatgggagggtgatttctgaatttcccttcataaaatacagcaattgtggagtcataactcaattacaaaaaaatgtagccttgactggaacttggaacaagacatcctatctcggtctggaagcacttttacttttgaaaaataaataagtaaattctgtttatggttttaaagcttatttttaatcttgcattaaatccaagaaaacaagggtacagcaaacaaacaaacatcagagatcaaactgtcgaacgcgggtcaaccatagcaattgattgaaaaactcaacaagatctagaattaagagtgtacaaattacagctcataaaacaaaggcaatacacttttcttcaaaaagtccactagctattttctacctattttcaatatgaagtgtgaatcttgcactcagtttgcatcacaacccacaagggaaagcttttcagcaacccactgataggaaattggggacctaaacaagctggattatctcctttaagaaagcgggaacactattctggaaccaagtctgcagaggtcaaggaagccagagctttatcactgaatctcaacacctgtggatactaatctgtccaggctgcattgtccattcacatgctgcttgaaatttaggctgtttaacactgaacaactccagcaaaaaaaaaaagaagaaagaaaaaatcttgcagctctgtttgtagtgagaaaaactgtagacatgaagccagggaacctatgttcatattccagcctgattattcgttagctgtgtgacattaagtgggtcatccaacctctctgaatttataaaattatttatataatgggaatatctaactgttgtgagaataaaatgcaaacactttgttttgtagttttaaatatttggtaaaatgtacatatagtaaaggaaataattagcatatatgagctccattagaaacaaaaattaaaatgacagcaagattaaatagcaacaatggtttctttaggatgatacaattatgggtgggacttctacaagcttctttattcctcttcctttatacttctatgcacttctctggaagtacagaggtttcaaacaaccagttgcaatagtctgggtaggcaacactgttggaatcatatgcccccctctccccttctggttataaaatactgagtggttccatttccatatttccccagtggtcaatctttggcatgagatcaaacaccacaatatgttttagaagggtgtgagaaaaggaaagcagaccactagaacttaagggctttggcagtctgaactatgaggtgagtttggagaggatgatttaaaataaatgaggaaaaaaagcctctggcttttggcaagagcacatgaaataccattgcacggctctcctgcctctgtgccccatccagcaccattaggaagggatggatatttgcttgctttggattcagtatttggctgttcttcaaaatattccatccatttccaaatgagtactggcttcttccagacctccagatcataagacatttaagatcagggtgaaggccccatggcatagcaacatggggtatttactctggcctcttgcgagatgtttataatgagacattaagctactatgggtgttttctgtgcttcaactttacttatgtggaattctcagaagacacctcccctcctaaagaaggatcttcttctcaactgtggatacttccatctcttcaagatccccacaggcccatgatgtttcctgatatctggatgaaggggacacttgaagccacagcaatttgctgcagggcagcctctccttttggcaatactgagtcttttgtctaggaaaagacagcccagcaactgcctccgtttccattgttctctagtactggggtgggtttgcaggaaagttgcctctgagcagatggcagtgctgtttgatggagggatttcacgttcagaacaccaatgaatcgaggtttgtatgttcacactgtgcactgcttcgtacctggcacaaattgcatatttttacagtattgcctgtggatatggcccacttaaattgcctgtgtagaaatcatggctcaatttatgtcctgttccaaatctgctgcagaagagtccatcatgcaagagactaatttttaattggcagaaggtaaggaaatcgttttttacagaattttttttaaatagctgtaacatttattgaaataaaatattggatgaaattcaccatatatgtcaactcaatgaaaagattcaggaagctgaggttaaagtcataagctgagagaagagattataaaaggtacagaggaagaatgttcacccttgaatggctgagtctctcagagttctgctccaaactttcttctcattctacattctctctctgctggattccatcattcttgtcctttcaaagccctcctctttgctgaccacctatgtatgaaatctacattccaagtcccagcctgtttccacatttcccatttcctgtggcttacccaatatttctggtaagaaggtacacaaaagctcaccaaattaaaacatacaaaaccatcatcttcttccctaaactgcttatttgtcttccttttctatgtagtttgcattatctccatccacccaactgcccacattacaaatcttagagtcgttcttgatattttcttcttcacagctagtcaatcaccaaatctgtgcaatgataccactgacatttctgtagcatcatcctccttcttgctgcccacgattatttcccttatccaggtcttcttcatcgtacctatcttatctcatttaatgcaagtcttttcgttttgtttttttttttctttgagatggagtcttactctgtcgcccaggctggagtgcagtggcgcaatctcggctcactgcaacctctgcctcccaggttcaagagattctcctgcttcagtctctcaagtagctgggagtataggcgggtgccaccacgtcctttgctacttttagtatttttagtagaggcggggtttcaccatattggccaggctggtctcgaactcctgacctcatgatccacccgcctcggcctcccaaagtgctgggatttcaggcatgagccatcatggttggccttaatgcaagtcttttaagtggtcttgcagtacatgccaagtatgccaccaatattatctttcaaaaatatagatttcaggcagttcctgtggctcacacctgtaatgccaaggttttgagaggctgagacaggagaatcccttaaagccaagagttcaagaccagccctggcaacatagcaagaccttatctctaaaaaaaaaaaaaaaaaaaaaaaaaaaaacttgtgaaattaaaaaaataataataaattagatttggacatgttatttcctatgtaaaacatttctaaaacttccatagttaatggcaagattctctggggcaaacaacccagcgaaaaccgcagaattaaaaaaaagatactcccatacaatgcatatcaatctggcttggttaactaattatttctttttaatttttggccaacctccctccccacaccacttggccttaggtatgtgacccccacatgcaggccttctccatgcctttagaccccctggattctcactcccctatcttcattcattctgattcattttcctggaaattataaccttcctcctagacagaattaattgctttctcatctatgtttccagagaaagttatatattcatctcttatagcactcttcatgctacatctttattatttatgtgtctatgtctgccataagttttaatgtttcaaggacacagattgacccttacttatctttatatcccaggccatgtgctgtgtgcctgccaaagaggaagtgcttcaggaccattctctgaaatgaattaagaaaatgcctttgttgcttgtgatgaatcagaaagccacctgacaaagactcccaagccatgaatccccaaatacttactgccagcactaaagacacctgaaagagatgtaatagggtccagaatcccccagtgaaattcaacttgtttattaccatagggctttggcctacaaaacctgcccttgtcacttaagctgaatatgtgagaattaaagacattcttgcctctagcctaagatttagcccatgtttttctgctgtgactcttgggatctcatgggataaatgggtagaaaatgcaccctaaagcaagagactgatttttaatcagcaatttattatcactactccctaacacatacacacacacacacatatatacacacacttccacccttagtagaaaggcatgatttttttctttgactttgacccacatctttagtccttttcaagaggctgagatttgatcttgattataactctagtttttatttttccgaaaatttcaagtctctattagaggtagttgccaaggcagtagtaagcgcaaagacgtatagtcttccatggaatgtcctttcctaccctatagggactctcataggcagaggagcagaggacatgagagtggaaagacacagaaacttttaaaatcacagatgacttggtcagagctaagcaccagaaagataacagtgaaaaacatatgaaaaatacactgaagcaacaggcttgaggcagggaaaccagagcagaagatgcttgcaagatccttggaaagagattctgaggtcctaagtgagagtcctggtaatgaggaaagagaagggaggtgggatggtggtggcagcattaataatagaggtatatgtagtggaagcaattatcagttgtactcgggtttcaatgaacttacaaaagacatggtgtcaagtggtttacattcattaaatcattgaaaacctggataaccagtctacgaggtatcctttccactctagattttaaaaactaaggcctagagaagatagcaactttcacatggtcacacacttcttcagttggagaaccgggtcttgaatttcagtctgatggtccccagagactctactcttttgcttaggaggtaggatgaatatgacttattgagcttctagaagagtgtagaacatgaaagaggaaagaagagccaaagctaagcatagagctttgtgcctggatgactgacagcttggcgatcccattagtagaagtggggcacagaatagggaggaacagatttcctggtgggacaagttcaatgctaggtgtggtaagtttgagacacacgtggtacatctacagggaggtgtgcaattggctgttgcagatgagggctgaacccaccaggtcattttctcaaatgccttgaggaccaaatgtggattacaaaaatgggcatagggagacaaccttcaaaggcagatacaacagttaaatctcgatgcttaaagctgtttgaaacagaccccagataatgcagtccagcttcctctactcttgcttttaagtgaagagacaatataagttttgtattattaaagcatatttcctcctcagccctgggcctacaatcagttccttcatttgtaaaataatgatttagcaataatttacatttcctcaagaaagcatgtaaatttgatattggggtataagcccaactattctgatttttttaacaatatatcacatagaacatctggctagttccccagattttgttcatggcggtatttgaaagtttttctccatttctgtttaaagcaacattagtcaccttccctttcatatctacctctttctttttcttcctttctttctttttcttttctttacttttgttttctttttatttttcttttcttctttctttgtgtttaagatacaattcaattcagtgtgtttgtcagtgggtttgctatcatttggtaggcagagtttctggctggcacactatgataatcctccagggcactatttctattatactcttgcagaagggatatactaatgtgaatacctttatgtaatataaagaccagaaaagggagaatcaatacatattttgaagtaaatagttctaagagattcattgttacatgtaaactaaccacagagattcagagcactcctcaaaaaaaaactttgaatatactaccatttgccacataaggaggttttgggcaatgacagaccatgcacatgaaaggaatcccataagagtataatgaagctggaaatttccgattgcctagtgacattgtagctgtcataatgttggagcatgtaacacattacttacgtgtttgtggtgatgctagtgtaaacaaacctactgtgtcttcagtcatataaaagtacagcatatacggttatgtgcagtacataatactggataatgataataaataactgtgtttctggtttatgtatttgctatactattctatttatgtttattttataatgtattccttctacttataattaaaaagttagctgcaaacaagcctcaggcaggtccttcaggaggtattccagaagaatacattgctgtcttaggagatgacggctctgtgtgtgttattgtccctgaagaccttgcagtggggcaagatttgagggaagaagttagtgatattgatgatcctgaccctatgtaggcataggctaatgtgtgtgtgtgtgtgtgtgtgtgtgtgtttgtgtctttgtttttaatgaaaaaatttaaaaagtaaaaataaataaacaattgaaaaatagaaaaaaaagccttgtagaataagaatataaataaagaaaatatttttgtaaagctgtataatgtgtttgtgttttaagctaagtgttactacaaaagagataaaaagtttaaaaaagtaaagtttttaaagtaaaaatgttacagtaagctaagattaatttattactgaagaaagtaacgtatttataaatgttgtgcagcctaagtgtacagtattcataaagtctacagaaatatacagtaatgtcctacaccttcacatccactcaccactcactcactgactcacccagggtaatttccagtcctgcaaacttcattcatattaaatgccctatacatgcgtaacttttttaccctttatattttgtgtttttcctatgtttacatatgtctagataaacaaacacttatcactgtgttacaattgcctacagtattcagtatagtaacatactctacaggtttattgcccaggagcaataggctatcctttatagcctaggtatgtagtaggctttactatctaggtttgtgtaagtacactctgtgatgttggcacaatgatgaaattgcccaatgatgcatttctcagaacatatgtccattgttaagtgacacatgactatagatataagaataaaaataagtggataaggagtagatggaagtttccagttttaaaagacttatagattcagattcatgtgaatttaatttcagtctaattcaacaaatatttttgagcatctattatttacaagatactcttcttagcaccatgtagactataagaaagaaaaagccatattatctctgtcctaaagaagcttttattctaataaacaatagactgtgattggtaaacacatgccacatgttccgtatattctaatcatttttccatggcggacattccttctcacttatgacattcttttccactgagctggacaaaatctcacactccattttattactgtgatccaggcattaccaccaatcaatctaatttgacaaacaaaataaaacctatttgtcccccagggccagatagatgcatacaaattaacatttcaggcagattttattaaatgctatatagagaatcaatatcatcttttaggaagagagaagatgggagagattaatttgaaatgggaacttttcaaaaagattccatggtgaatgtggcattgcactggacattgaaggatgagtacatcgttcaatcattcatttaacaacatctcacagatcacctggtacaccaagcactatgctgagtaccgagctaaatgctgcattcgattcaagtcccagttctacttctgagtttcactagaataatttagaaaatccctgaaactctatgaccctaagtttccctatctgtttggtagagacaagatgagatgattattaggagaccttgtggctccttaaattctgtaatactgtgaaaattattctggccagaagcatgagaagatcaatagccaccactcttttctagtattccctaatccaaattatagtctatcgaactatctaaagtctcttcttgcagtacaggagtaagaaaaaaactaatgtggtcaagatggagcacagactctaacccctttcactaagggtacagagctgaggatggagagtctttctgcacatcagtgtttgggtaactagtcatggtaggccagctgctgatggaagcgacttcaactctgtgtctcagcagcaggaaggtggggctctaccacacagacattagggacccaggattcttctaatttgtgtcttggtcatccttagggcctcagagtccctctaacagggaagttgccatgtgaaagccatacctattgttaactgcctcactccaggtgtgacatagatctctgccactgtcatttcattggtgaggatttgtctcaagacaacactgagaggcaagagtggtgcacatataatatagctaaatgccagaataaaaataaataagatttggtgaatatatagcattttctctgacactctaactgattcatagtggatcacaatttttatctcattattcaaaatatttattcttctttgtcagtatagagtggaaagacatgctctcaacattgtaggggatggtatttctttattggcactagaatctttcctgaaagagctatggttaagtgaagtgtttccaacatgcttatttttgtaatgaataatccaagtttaggacaggtaaactaatggcttcccaaagatgtccacattctaatctccagaacctttgaatttgatactttacatggaaaaagggactttgcagatgggattaaattaaggatcttgagatgcaaagattagcccggaattattcaggtgggcccaatataagggcaaggtgaggtgccttataggtgaaagagggtggcaggagagttagagtcagagaaggagacatgatgacagagcagagatcagagtgatgtgatatgagaaagactccactggacattaattactttgaagatgaacaaattttaaaaaggcaaggaaataggccagcccagttatgctgatacatgattttagcccaggaaaacccagaggtcacccagtgaccttgacaacagtaagataatatatttgtgttgtgttaagccaagtctgtggtcatttgttacagcaataatatgaaaataatacagagggaaaggaccaaaatcagtaatagctaatatttattgagtgtacactgtgttccaagcattgttccaagccttacaattgttaacacatttaatcctttaatactatttttagtcccatgaggcaatgagaaaatgggtacagagaggctaagaaactttcccaaagtcacacaactagtaagtaaaagagctacaatatttatccaccactaggatcatatcattaaagaaaagtttgatatgatagattaactaaaacacatacacatcagacacacacacaggcactgcaatattttgcaactccttccttcaaaaacccatgagctgagattgctaatattattttcagcaaatctataaaactgaaagctaatctacactgtttggaatctatttttccaaccaacccttatatctgggcttgttcatgtgatttgttttgtccaatagaacagcagcaacataataaaagcagaagctttaaaaagagcttgcacactggagtttgccctctcttgtttttggaacccagtcaccacggagagaaaaagccagagctgcctatcagatgttagaaatacgtggttcagttgccccatcacctgatccaaactccaaataggtgactgaagccatcttagaccaacaagcctcaatcagccctctgactataccacatgagtgagtctagataggacatgcagaagaaccatccagctgagcccagaccaaatggccagcagaataaaatcatgacaacaaataatgtagcaaaaactaattcaaaaacatgggccattgagaagttataacactttggaaatatattcaacatctcaggcctttttagctaactcttgctgactcctaacgaattagtattggggttggtgattgaattaattcgctaccttccaaatctctttataggttttctgaaaataaaagtagcaatctcaaccactgtgctcttaaataaaaggaaaggtactacttttaaccaaaatcataactggcataataggaatatctgtaaaaaaatttaaaatacctatttagcattaacaacatgcagttttattaaaatgcttagcacttttgtctatgaagatcttaatgtctttttgccatagtcctccagttttgagtttaatatctttaacaaacagaaactctattttattttttgaagaaaaaaaagttcagacataacttaggacattataaagcagttttttaaaaaaacacagaaaagttttctaggagtaagtactatggaagaattacaggaccccaacagaaaaggcccataattgttgctgccacatcaatgcaatttactatagtgcatttttgacccaaagccagtccatcaccataccccagatttttaaatgtttaagatgaaaacttacgattccagaaaccacaccattgcagttctttaacagactctattccattattcaaagtagtttatatgatcctagagtcaccagaaaatcttataacttgcctctggttccactagggaaattatgcttccctatttttccacaaccttctaaagcaactgtacaaaaatcaaattgtttttctagaagtcaccaataacgtttcacattttaagcaacacaaaaaaagaagcctgggttccagctcacacagtgatttatgactaaccccttctgagcaattcctatttatacattcatttgtcgtgtcctcgggtgctatatttttggcagcatcactggacacaatatagagggtcccaattttccccctgaatcttaagaaaacacttggcagaagtgaaatgatactgccttttaattttcttgtagaaatctgcggtttgtgtaacatgactcagtctagttctgattaatggggatgcattttgttccctgcaatagccaagtccacaggtattaaaagctctcacaatccaaatattggaattaaatgcaaagccctgagctcagaatttactgctctaaggaagagattacaaaggaatttgaaataaatccagtggtaaatttaaggaagttcctgagctattgtttcctcctgcaatggatgcctgcgaccctggcttgataaactgcttggataagaactggccccaaagtaacctttgtactagcagtgatgtaaggaatgactccctgtaactaagggagtatcacatatgaatttgggggccgatatacaagataggattatcctgttaagactgtcaatagtgaggtcatgcctgatgtcagtcaccctcagacaggaaggctgaacacagaaaccattcctctcaaagcatcactctgaccacattagtatggctgctcaaattgtgatagctatttgatgcctatgaaaataagttaaaagaccttagctggacgttaaagtatcctccaacatttaaattctcaaaccccattttcaggcattacgtttcctttttgtgatctgacttcttatcctttccttccccctgccattgttcatcatgttttcccttactggaaatagcatcttttaggtttcaaggctctccagtgctacttcctcattgttatgatcctcttgccctcagctagaagtgacgtctttatccttttaaatgctagcattttctgcactttttaaaaataagttttattgtgtatatttaagttacacaacataagatacatacatatagtaaaatggctactatagtgaaccaaattaacatattctttatctcacatagttacccattccccccgccattgtcccatggcaagagcacctataagctactcatttagcaaaaatactaaatataatacactattattaactatagtccctcatgctttacactagatcttttgatttgttcatcttacatagttgatacattgtatcctttgacctacatcttcccttttctcccctgccatcccaaccatggtaatcattgttttattcactatctctatatataagacatatttttatttcacgtataagtgagatcatgcaatatttgttcctttttctatgtctggctaattttacttagcatgtctttcagatccttctgtgttgcatcaagtggaaggatctccttttttaaggctgaataatattccattgtatatctataccacagtttctgcatcctttcacccatcaatggacatctagattctttccacatcttagctattgtgaataattctggaatgaacatgggagtgaagatacctttatgaggtggcagtttcacttattttgggtacgtaccttaaagacatattacagggtcacatcgtagttcaattttgtatttctttaggaacttccatattgtttgtctttgtggctgcactagtctgcatttccatcaacagtgtacaagggttgcctttctccacacccttgtcaacatttgctgtctcttgtccttttgataatagctaccctaacaggtgtgaggtggtatatcagagcagttttgatttgtgtttccctgaagactaatgatgttgagcacattttcatgtacttatcgattatttctatgtcatatttggagaaatgcctattaaagtcacttggccattttttaattggcggcttttgttattaaattatgagttctttataaatcttggatattaacctgttatctgatacatagtttgcaaattttttttacaatctacaggttgcctttttattttgtggcttgctttccttgatgggcagatgattttttatttgatatggtctcatttacttatttttgctattgcagcctgagcttttggtgcaatagccaagaaatcattgccaaggccaatgtcaaggacctttttccctgttttttcccctctattttttatttttattgagtcaagattttactcttttacccaagctgcagtgtagtggtgtgatcacaactcactgtagcctccacctccaagtatcaagaaatcctcctgtctcagcccccaaaagtgctggtattataggcatgagtcactgtgcctagcttcttctagtagttttataacttcagtacttatatgtatttctttcatccattttgaattaatatttgtgtgtggtataagggtcaaatttcatttattttgcatagggaaacccagttattccagcatcacttatacagctatgtggaatccagaaaactctctcagctgggtctagtgcctgtgaggactataggagcccctagtggtgagaactgtaggtatctaaagtagtgatggaggctgctgagtgctatcgtctaccttttcctcacagacagaagtccctcctggttccaaggtgatcctatctggggaatgggttagggaaggtgagttgtttccttccatcctctaggtagtcatcctgggtttctgttctctacaggatttatgctactcctttgatgtactccagtgctctcctttagctattttccttaaaaacgtttgtttatttatttctttggctgtctgtgtgagagggacaagcactaggagcttctttctagttggccatcttgctaatgttctcaaatgttctacactgtgataggacttctgtattacattgcttatattgccataacaaaataccatagactgcatggcttaaacaagagaaattaattttcttatagttttggaggctagaagttcagaatcaaggttccaactgattcagtatcaggtggagtctctcttccaggcttgttgatggccatcttcttgctacgtcctcacatggcctttccttggtgggagcaagcaggtggaaggagctctttcatgtttctttttataagatctttaatcctacaggatcagggctctatcatgtggcttcatttgaccttaaatactcccttagaggccctatctccaaccaaatatagctactctgggggctagagcatcaacatgaattttgaggagacacattttgtccataataaattctttttttttttttttctttttgagacagaatctcactctgtcacccaggctggagagcagtggtacaatctcagctcactgcaacttctgcctcccaggtacaagtgattctcatgcctcagccacccgagtagctgagattacaggcctgccccaccatacctggctaatttttgtaatttttagtatagagagattttgccatgttggccaggcagatctcaaactcctgacttcggcctcccaaactgctgggattataagtgtgagtcactatgcctggcctcctattaatgatttatttaattcattcaacaatatttattaacaacactgtgccactctactaggcactggaaatagaaagaagactaaagaatagtgtttgatcttaatgattcaaaaactggtagaggagacaggaatataaaataatacattattacagcaaaaggtaattagcatgatcagtcactatagggatgtaatcttacctccccatttgagacttaagctctttgggctaagtgtaaaacatgtcacctgagagaagatgagtagagatttcagtccctgactcttgatgagatgtttacctctacggaaactcaaatgttgtctccaaggaatatatacctatataaaggacattccagaaaaatgctccctttttcttactagccctgtcctcggctagagtccctatgtggttctgtaccaggcaatgctgagttaaataactgaggcccttttatatcattttatatcacacctcaccccaccccatcccatatctaatgtggaacttatctaaactactcattccaggcattcttctgactgggaaactccttattacatttggccttccaaaggcaaggcagttcccaagatgccacttgcagacctaatcttagcgtgaccttagtctgagggagtacagggtgagtcacaaagtagatccaagtttaaccatgcatcttcctgaaagtacactactctctatggtggctccattgtgcatactttaaaaaatctggctgggcacggtggctcatgcctgtaatcccagcactctgggaggccgaggcaggtggatcatctgaggtcagaagttcgagaccagcctggccaatatggtgaaacccagtttctgctaaaaatacaaaaattagctgggtgtggtggtgtgcacctgtagttccagctgctcgggaggctgaggcaggagaatcacttgaacctgggaggtggaggttgcagtgagccaagatagagccattgcactccagcctgggtgacaaaagagaaactccgtctccaaagaaaaaaaaaatctgttttgtccttgaactggaacagagttctcctttcctgagcagtagggggtaaaagagagctacagacattgagatctccctagagacagagtgagtgactcacatcaaggcctatcactgatttatctccacatgtatcacaatacttagcccagcacctggtccacagtaggtgctcagacagtgcttattaactgactaagagaagcaattactgtcgtattccctgccaatgaccttatttacttttcttagatatgggcataaacaaaccatgtaatttaatgtctgtaattgcacttgacaatcactgaactaatctctcacacattcttactccatctgagtatcatatacataactggattaaaacatcatctgtaatgcacagtaactgtagggctcccggaagacttcttcagacaagatacctgctgctttactgcccacattcagcaatagcccagattgccgaaactagctatgcagacttctcatcaacaagcttgttgtagcaactactccttcagcacataagcatctcggaatggagtgttgatcatattgcataacacttgccagagaaggatcagtgcatcagaaaagtgaaaaggacagactgtcctgatctctatcttaacctccgagctaattggcaagcagatttccactaaatttatccatctctcaacaatttatggaggtagttttgtatgctaaggcctggattaagatctttctccaacatcttgttgttaaaaattacaaacataaaggaaagttggaaatatttaactgcaaacactcacatttctgccacttaaattctataattaacattttctttactcactttattgcatactatttgttgctcaaaaccaagatgctcatcaattcattttaatctatgttaaacttttgaaatctctactttcatgccacaacacttattttaatcttcataaattcattaaatcagtcatctgttcagacacattatcgagtatcttctactatgtgtgaagaaatttgttagttgttggttattcaaagattaattaaaacaatctctatcatgaaggagtccccagttggatggaggatattatgggacacaataatgacccccaaagtgtccatgttcgagtctctaaaagccatgaatatgttaagttatatggcaaaagggaataaaggttgcacatggaattaagagtttcctggattatgcagatggacccaatgtaatcacaaaagttcttaatggaaaaaggggagtcagagatgagaaaaagatctgactatagaaaaaaagcacagagaaatgcaataatgttggctttggagataacagaatggggccatcaaccaaggaatatgggctggaggactggaaaaggcaaggaaatgagttctcccctggagcctctagaatacaatagagtgcagccctgctgacgtcttaattttagcccagtgaaacccatttcagacttctgaactacagaactatgagataataaatgtgggttggtttaagccactgtttttggtaatttgtgatggcagccataggaaactaacacagagctagacattcatgcatgattatgatgccatgtgatatgtcctataatgtaagtaggcacacagttatgttagaaaacacagcacggtcaagaaataattcatattgttcttgatagagaaagaaggaggtatctatcaggcaaacaatagaaaaggtcattctgaacaaaaggaacatttttgtaatgtcccagagacttaaaaaaagaatgtttttgaaatggtaaactctatgacgagttatgccagtcattcttaatcctattaaagcttctctttttataacaaacatttcgtagtgtctcatttattactctgaaataaaagatatagataacctatcccacataggtgtttgtgtgtatgtcataaccataatacaagggatgaaaaaaagtaaattataataaaatattatgtatttcaatatacaattgcttctcagtcatgactacctttgaatatacaataaacatttgcctacatctatacatattttcactttgaatgcagtaggtataaatgcaaactcaaatgggtgtgttatattgacaaattccatgagcagtgttaccatcagtgacagcgttttccagaattggtgaggaatcttaataaagttctgtaaaactgaattacacttttagttaaatgtgaaaggtcgttacatttcctataaaaatcagtttatagtaaaaatcacattaaaaaaaactaaacagatgtttaggtagaagaacttggaggaaaggttatttgatcatgaagctaaaaggtggatgaggagaagcctcccctttccagctccagctatggctgaggaagtggtagtgcttggagctgctgtggaatcatgaagagatagctatggaaaaagccagcatgagtctttgatgatgtcattgaactattgatttaataaaccctggaaacttcctatgttcaaaattatcgcatactttttttattgtttaagccaattctattttcttcctactaactatagccaaaaacaatgcaatggataaaataaatggcataactttgtccagcagtgtgtcacaggcagaccaggctgtagcaaacgctgttgtaaaccaaaactaaaatcctaaactcccccaagtaaccgaaagtatcccctctgggccaagaggatagcagagaaacctgaaaaactgaattccctgccaggaaggaaaagaaggtctggcacacctcatcacacctgcttcattttggaggttaggcacaattaaccaacactaacattaaaatatagatcagaagactgacaaaacaggctgtttgtggtagtaagaccaaattccaccctgactctggtgtaacatcacatgacagatagcagaccctaaaggaaataaactataatctatttgacatattttgaaatggccctgcaaaaccgtctttggtggaagaaatttgcctttgtagaaaatcttcattactgaagccagacttttcttagatctaggagagactaactaaaagtctgacaccttttaaggttcaaaaagatatttaccatctattttctctgagggctgctatctggaggcttcatcaacataacaaggaccttggtttatacagccccctttctcataattcaaacatttatttgtactgacttcaagtctttaggcaaagcttaactctttcaaccaattgccaatccaaaatctttggatctacctatgacctgtaaggccccatttggagatattttgtctttccaggctgaatcaatttataccttaaatgtattgatttacatctttgcctgtaacttctgtcccctgaaaatgtataaaaccaaactgtaacccaaatgtctggggcacactttctcagaacctcttgaaattgttctctgggccttagttactcataattggcttggactaaactcctttaaatattttacagtgtatggttttttggtcaacgctgttaatggcctatcctttcccttctcagagtcactaggaggatacaagataaactatgcaaaaaaaagaagaaaaaaaactgggcacatgtttactcctccacaattgatagctattactcatgctgttttgaagatattatgcattaggcacctgagttgtatatcagattcctagtgctgctataactatcacaaactcagtgacttaaaacaatacaaatttattatctaatagttctagaagtctgaaatgggtttctctgggataaaatgaaggcatggacagggctgattcccttctgtaggtcccacaggagatttcatctccttgtcctttctggcttcaaaatgttgcccacattctttcctctacattcaaagccagcaatttcatcactccgacctctgctccagtgatgacatctcctctctgactttgacttccctgcctccttcttatggggagacttctgattacatttcacccaccagaataatccaagttaatctccccatctcagtccttcacgtaaccacatctggaaagatcctaataccatgtaaggaaatacattcacaggttcctgcctaccacaagttgcaagagagtaccacttggattcaatgttaccatatagttaggaaagcattttgagaataaaaaaaaaacaaaagaattagttgtccttccttggtcagttcaaggtttgtactaattcccctctttatgtattatccagagatcattcagtttcataaattacagaaacccaatacaaactgacttaaaaaaaaaaaacaactagagttgaatgggttggttcatagaagtgctggcttcaagcacagttgggtacatgtactcaaacaacatcaggattatggccatttgcaacccttgagtctgttctcctcctagttttcttcattcttgggcagacgggcaagaagatggccattagcagtcccagaaacatattctagagaccctatggaaaagatacccatattctccccaaattttagcaaaattcccaagactgaccagtctaaaccaggttatgtactcatactccaagctagcctatgggatcagtgctaattaagtcatatggactgagaatagagaggagtgttccttctaaataaatcggcactgtgattaaaaaaaggagaatgaatgatggtcagacaaaaaccacagatgcactacccaactccctctgaagaaaaattagctctctggagccccacttgggcaggaacacttggatgcttgtgacttcagtttcaggtccatggtgggcaaagactcctggaagtgatggagtgctacacagccaaactgcaactgtatttagagaaagaacagagatagttttcattctgaggcatgaggacaaacctgctcttctgcaactatgcttattctccttttaatttttgtaggaggaagagtaattgcaatgcttaactgagggtccaagtaaccactggaggttctggaagccctggctcatagacagatgtccaaaaactgaaaaacagaagtgaagggttgcagacacagggatcctttcctagcatgcctccatggatttcaatagacatagaggttaagcacaaaggctatggaggcagatggcttgggtggaaacccagcttcatcatttcctcattctgtctcctaaagcttattttcctcaactgcaaaacagaaaacatagtaatatccatgttgtgtgggtattttgaaaattaaatattagctgtggtattaggactgtattagtccgttttcatgctgctgataaaggcatacccaagactgggaaatttacaaaagaaagaggtttattggacttacaattctgcatggctggggaggcctgacaatcaggatggaaggcaaggaggagcaagtcacgtcttacgtggatggcagcaggcaaagagagagcttgtggagacaaactcccatagttaaaaacatcagatcttgtgagacccattcattatcatgagaacagcacaggaaagacctgcccccaaaattcaatcacctcccactgggtccctcctatgacatgtggaaattgtgggagttacaattcaaaataagatttggtttgggacacagccaaaccacattattccacccctggtccttcccaaatctcatgtcctcacatttcaaaaccaatcatgccttcccaacagtcccccaaagtcttaactcactaactcaaaagtccacagtttaaagtatcatctaagacaaggcaagtcccttccacctataagcctgtaaaatcaaaagctagctagttatttcctagatacaacaggggtacaggtattgggtaaatacggagattccaaatgggagaaattgaccaaaacgaagggggtacaggccccgggcaagtccaatatccagcagggcagtaaaatcttaaagctccaaaatgatttcctttgactccatgtctcacatccaggtcacgctgatgtgagaggtgggttcccatggcagctctgcccctgtggctttgcagggtatagcctccctcctggctgctttcacgggctggcatacagtgtctgtggcttttccaggcatatagtgcaagctgttggtggatctatcgttctggggtctggaagacagtggccctcttctcacacctccactaggcagtgatccaatggggattctgtgtgggggctcccattccacatttgccttctgcactgccctagcaaaggttctccatgagggccccaccctggcagcaaacttctgcctgggtatccaggcatttctgtacatcctctgaaatctgggccgaggccccaaaccttaattcttgacttcggtgcacccacaggctcaacatcatgtggaagctgccaaggcttggggcttctactctctgaaacaacagcccaagctatactggtcccttttagccatggttggagtggctggaacacagggcaccaagtccctagactgcacacagcagagggactctgggtctggcccacgaaaccatcttttcctcctaggcttccaggcccgtgatgggaggggctgccctaaaggtctcttacatgccctggagatattttccccattgccttgagaattaacatttggctccttattacttatgcaaatttctgcagccagattgaatttcacctcagaaaacaggattttcttttctatcacattgtcaggctgcaaattttccaaacttttatgctctgtttccattttaaaactgaatgcctttaacagcacccaagtcaccttctgaatgctttgctgcttagaaatttcatctgccagatactctaaatcatctctctcaagttcaaagttccacagatctctagggcagaggcaaaataccaccactctgtttgctaaaacataacaagagtcacctttgctccagttcccaacaaattcctcatttccatctgagatcacctcaccctggaccttattgtccatattgctatcagcattttaggcaaaaccattcaacaagtgtccaggaggttccaagctttctgacattttcctgtcttctgagccctccagactattccaacctctgcctgttacccagttccaaagctccttccacatttttgcatatcttttcagcaacgtccccactctactggtaccaatttactgtattaggcatttttcatgctgctgataaagacatacccaagactgggtaatttacaaaataaagaggtttattgcacttacagttccacatggctggggaggcctcacaatcacgatggaaggcaaggaagagtgagtcacatcttatgtggatagcggcaagcaaagagagagcttatgtagacgaactctcatttttaaaaccatcagatgtcttgagacccattcactatcatgagaacagcacaggaaacacccacccccataattcaatcgcctcccactgggtccctcccatgatgtgggaaatgtgggagttacaattcaagatgagatttgggtggggacacggccaaaccatatcaaggataaatatggggaaagcattttatagatggtctagttcctcccacaagcctagagatgtagaatagctttgcccaatgtcacacagataaagatgagcaggagggactagaatttactcttctcagcagctgctctggtgcaggatcaactggtgtgggactaacggaataaaactagctatcattacacactaactattggcactccattgtatttgggctttataaacattatttcataaagacttcacaataattctcaaaataacccctgttaaaacctatgagaaaactgaagcttagtgactttaaactgcttgctccaaatcatacagcttttaaatagtaaaaccaaatctgtctgtctgtctatctttaagtctctgtatactcttgctgacaatgctcactcatgcaaatatggagactgcagatcaggatagggacagccagccagccacagatgatgtcgaataaggatccataattagaactcccaggagacagaagtaagaaaataaatggaagaatgttgtttgggctcagaaaacttgtagtttgggtgtgtaaccaaaataagggtacttatgtattttctatgttctggttaaagctatgcagtttggcttgtcttattaatatattattttacttacggtattattgtcttgattttattacatgtagaatctaggaaactgagaaagtttagcaatttgcccaggatcagctagctggtaagcagtggaactgggacacaaacataggtctacacatgccaggtcaatgctcttcccacaaagtcacacaaagaaagtcccaaacaaatgcccagcctgcagctgcacagagcctacatacacatctctgcaggactcgcattcctgccattttccttctttctcgcctgttacaggcctgctgttaccagcttatttaattcctgcaatttgcactgtttctcacaatctgttctcatttgctagaagtgctcactcaatagctccactgtttgccaggaaatcaggcctaaaaatgtgcagaagttctcccacattctgctaaaccctagttcagtgggtctgactgaagtaaaaccattggaacaacttttgcaggagtctctgtgcaaggagcagattcttattcctgactttcactcagctctgccataaccaccaaagccaggggctgggtagaaggaagcccactggactgggtctttgaaaatgttctgctacttatttgataaggaaaccaccaaaattgtaaatgaaataataaaagagatctgacctaaccaactccatcttgcttctaacctccaagctgtccttgttccttcctgggtgtaggctgaactaactttgggaggaaatttgtagtttaaaacaaagatgacaacagtcctttcccaaggcaaatccacttcttggctgggaactagactgcctttttaggactaacaaattagccacaagataatacaagattagaaattatggtttaggagtcatgcaaccggaggctacaagatactgaccctccataaactgctcttaagatcagttcttgagttctgtagatgtctgttaggtctgcttggtgcagagctgagttcaattcctggatatccttgttaactttctgtctcattgatctgtctaatgttgacagtggggtgtttaagtcacccattattgttgtgtgggacctaatagacatctacagaactctccaccccaaatcaacagaatacacattctcctcagcaccacatcacacttattccaaaattgaccacatagttggaagtaaagcactcctcagcaaatgtaaaagatcagaaattataacaaactgtctctcagaccacagtgcaatcaaactagaactcaggattaggaaactcactcaaaaccactcaactacatgcaaactgaacaacctgctcctgaatgactactgggtacataacaaaatgaaggcagaaataaagatgttctttgaaaccaatgagaacaaagacacaacataccagaatctctgggacacatttaaagcagtgtgtagagggaaatttatagcactacatgcccacaagagaaagcaggaaagatctaaagttgataccctaacattacaattaaaagaactacagaagcaagagcaaacacattcaaaagctagcagaaggcaggaaataactaagatcagagcagaactgaaggagatagagacaaaaaaaaaacccctccaaaaaatcaatgaatccaggagctggttttttgaaaagatcaacaaaattgatagactgctagccggactgataaggaagaaaagagagaagaatcaaatagatgcaataaaaaatgataaaggggatatcaccaccaatcccacagaaatacaaattaccctcagagaatactataaatacctctacgcaaataaactagaaaatctagaagaaatggataaattcctcgacacatacaccctcccaacactaaaccaggaagaagttgaatccctgtatagaccaataacaggatctgaaattgaggcaataattaatagcctaccaaccaaaaaaaaagtccaggaccatgtggattcacagccaaattctaccagaggtagaagaaggagctggtaccattccgtctgaaactattccaatcaatagaaaaagagggaaacctccttaactcattttatgaggccagcatcatcctgataccaaagcctggcagagacacaacaaaaaaagagaattttagaccaatatccctgatgaacattgatgcaaaaatcctcggtaaaatactggcaaaccgaatccagcagcacatcaaaaagcttatccaccatgatccagtgggcttcatcccagggatgcaaggctggttcaacatacccaaatcaataaatgtaatccagcatataaacagaaccaaagacaaaaatcccatgattatctccatagacgcagaaaaggcctttgacaaaattcaacagcccttcatgctaaaaactctcaataaattaggtattgatgggacgtatctcaaaataataagagctatttatgacaaacccactgccaatatcatactgaatgggcaaaatctggaagcattccctttgaaaactggcacaaaacagggatgccctctctcaccactcctattcaacatagtgttggaagttctggccagggcaattaggcaggagaaggaaataaagggtattcaattaggaaaagaggaagtcaaattgtccctgtttgcagatgacatcattgtatatctagaaaaccccatcatctcagcccaaaacctccttaagctgataagcaacttcagcaaagtctcaggatacaaaatcaatatgcaaaaatcacaagcattcttatacaccaataacagacagagagccaaatcatgagtgtactcccgttcacaattgcttcaaagagaataaaatacctaggaatccaacttacaagggatgtgaaggacctcttcaaggagaactacaaaccactgctcaatgaaataaaagaggacacaaacaaatggaaggacatttcatgctcatgagtaggaagaatcaatattgtgaaaatggcaatactgcccaaggtaatttatagattcaatgccatccccatcaagctaccaatggctttcttcatagaattggaaaaaactactttaaagttcatatggaaccaaaaaagagcccgcatcgccaagtcaatcctaagccaaaagaacaaagctggaggcatcacgatacctgacttcaaactatactacaaggctacagtaaccaaaacagcatggtactggtaccaaaacagagatatagaccaatggaacagaacagagccctcagaaataataccacatatctacaaccatctgatctttgacaaacctgagaaaaacaagcaatggggaaaggattccctatttaataaatggtgctgggaaaattgcttagccatatggagaaagctgaaactggatcccttccttacaccttatacaaaaattaatccaagatggattaaagacttatatgttagacctaaaaccataaaaaccctagaggaaaacctaggcaataccattcaggacataggcatggggaaggatttcatgtctaaaacaccaaaagcaatggcaacaaaagccaaaattgacaaatgggatctcattaaactaaagagcttctgcgcagcaaaagaaactaccatcagagtgaacaggcaacctacaaaatgggagaaaattttcacaacctactcatctgacaaagggctaatacccagaatctacaaagaactcaaacaaatttacaagaaaaaaacaaacagccccatcaaaaagtgggcaaaggatatgaacagacacttctcaaaagacgacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgcttgagaggatgtggagaaataggaacacttttacactgctggtggtactttaaactagttcaaccattgtggaagtcagcgtggcgattcctcagggatctagaactagaaataccatttgacccagccatccctctactgggtatatacccaaaggattataaatcatgctgctataaagacgcatgtacacgtatgtttattgcggcactattcacaatagcaaagacttggaaccaacccaaatgtccaacaatgatagactggattaagataatgtggcacatatacaccatggaatactatgcagccataaaacaggatgagttcatgtcctttgtagggacatggataaagctggaaaccatcattctgagcaaactattgcaaggacagaaaaccaaacaccacatgttctcactcataggtgggaattgaacaatgagaacacttggacaccagaaggtgaacatcacacactggggcctgtcatggggtggggggaggggggagggatagcattaggagatatacctaatgtaagtgacgagttaatgggtgcagcacaccaacatggcacatgtatacatatgtaacaaacctgcacattgtgcacacatagcctagaacttaaaatataattataaaaaaaaagataaatgcttgagatattttgcagaccctgtacttcatggatcagctggcaccacccagattcataaactggctcatctgatcttgtgacccccacccaggaattgactcagcgcaagaagacagcttaaactccccatgatttcatctctgacctgaccaatcagcactcccgactcattggctttccccaacccaccaagttgtccttaaaaactctaatccccaaatgcgcagggagactgatttgagtaacaataaaactctggtctctgccaggcatcatggctcatgcccgtaatcccagcactttgggaggctgagatgagtggatcacctgaggtcaggagttcgagactagcctggccaacaagatgaaaccccatctctactaaaaatgcaaaaattagctcagtgtggtgatgcacatctgtaattccagctactcaggaggctgaggcaggagaatctcttgaacccgggaggtggaggttgcagtgagctgagatcgcatcactgcactccagcctgggcaacagagtgagactccatcccaaaaaaagaaaagaaaaaacaacaacaacaacaataaaataaaaacaaaactctggtctcctgcacagctggctctgtgtgaattactctttctttattgcaattcccctgtcttgataaatcagctttgtctaggacccattgggtggttatgatatcaggtaagtaaaacaaaacccagtttactctgtttcctatatgcacctgcaactgtctataacacagggatgtctaccacccagccactgtcctcagacgctagtgcaagaggcagacaggtcaaccagcagtttcaactcaggaagcctgaggatcttggcacacaggagcaggttaacttcatcgggtgtgtaatctgtgaattttcacaaagctctgcacttagcagggcttgtgtttggtttaatgttctgctgctattgtgttgacattcttagtgatttttgagcaagggctcctacattttgattttgtgctgggccctacaaattaggtagtcagttctgcacagaagatatgcttctcgtccaaataaatggtaatagaaatggctcagggaggaatgatgccccttgaagaataaaaaataagaaaatgggaaacggcatgacttctacttttgcatagagtggtgaaagagacaagaactctcagtatttctgggtacatgaatgcgaagcacaagatgggaaatagggtgtataggaggtgagaatggaatctttaagtgtagtcagagcatgaaaggctttggatgccatcctcaggagcgtgaattttataacaagctactggagagactacacacggagtgacaggtgagacctccattttagaaaaacttctatggacagaaaatcaattttagaagggtaaaggtgaaacagagagtgaccacttagtaggcaattataaccatctggtcaagtagtaaggagaagaataggaaaagaagggaagtcatgcatcaaagaaataggaaataaaattggtataatgcgatttgacaaacatttcaacttccctaccttatattgatttttctcttctctataaatatgaccccaattttagggatgacagcaggaattaaaataatccctcttttcattcttctttgaggtgggagactgtggtgtttatattgtcttgcctggtgatatacatgcaaaaggcactgggcaccagtggagggcatcttccagggaagctactgttctcctgattaaaaaaggaaaaggacagactcagttaattgatggctattgttcaaggcccttccattttcttctcattttgtgattgcaaggaagagttgcatgctaaagatagaagaggaggaagctgagaggaacattggtccttcgtgactcaggccaacattgtcacttgcttccaacagctaacccaggcttccttttactgagaaaaatgaaagccagtttagctaatccacagtggatgggcctttgttaaattccttgcatgcagtcctaacaaacctactagagctgtgatctgaacctggctttgtacctgcaaagcctgtgcatgaaccatggaagtgaggcttcccaacaccaaaagctggtccaaaaaccagtgttacacaggccaatgatcttgtcttttacactcacaagaaacacctttttaaatctcttttccaaaacctgcttggatctgattgctggaattggttggtcaattaagacacatttgagggagtaaatgctagtagtagtttagattcacctagcaagctcatctctcctgctggaaaagataataagagaccagtgaggggtaaaatgtggtatggattcatgttctgaaaaccaattcccactacagctctaactcaaagggccttaagaaagaagtagtgtccagattcttgggcaaaagcaacattaggattcagggactaaataaaacttaaataaatcattgtttccacctttccactaacatctgtccttgtccagcttttttcactgttagcaacaaaaacaataatagtttttacctactgagtatgttctatgtgctttagaatcataatctgtttaatttttaaccttcaagataaagattacaactccttgtgaaaaatgaagaaactgagcttcatagagatgaaataacatatccaagtcgcagagttgataaatggtagaggtacaattcaaactgagacctgtctcaatccaaacaccacgttcctaaccactcagctccaactactgtgtcctgttaactgaacatactttgtgttttccaacagccttgcatctgttcacaatgaacaggaatacctatactgacggccaccataacttcaaccaaattcacttcagggctcattttaagtaagatttttaagtacgattttctccacgaaaatgtttccaatctctccttctttactttttaccaaatatggagtctccttgccctaatacaaattgcctttggttggtttgttttgtggtgcttatatctgctttgattataactgaaatattactattctcatcacttatactgaaagattctctgtgaaagcagtccctgatccttcctttggctaagggagatgagggggagcttgaagaggaagtgagagttaaatgctaatgatatcactgaataggggtacacactcagagttacttcatcttatcttcacttccatatgctccaaaggattaataatctgagagttcttgccaacagaatgtaggtaagtgtgatgttctccactcccaggcctgcccatacacatctgtgatataatccttcacctcctctcttcctcatttgttagctgggtgtcaaaaccctgggaagtcattgttcatcctgggcccctgaatgagagtgtgcagcagagcttccccaccccatcccaccccacccatgttattatttgggttctatatgaggaagaggtaaatgtttattatgttaaaccagggagattttgtctttaccagcatctagcattacttgaacaaatactcatagtgagataaagtagtttgttaaatgtcacacagctagtaagcgatggaatataaattctaaatcaggcagtgtagtaccagagtctatgcatctacttctacacaaatgctatactgtcccactaaatatcatttaccttgtctcttattaaactctaggttccttgataagaaatattacttttcatttctgaattattagaatttagtacttaaaagaaactcaaacaaactggaattgacaggaattaaattgcattgaataagatgttacttaaacttttcccaacatcatcactcacaaccccaccctactaggatcttacttaaaactagcattgtcaaattatttttgctttccctaaatctgttgcaaattcccagaagttatttgtgcctgggttgaagtccagtcaatatgttataattcatcttgacaagtcctatgtaagtaactcttttggcattctcccattatgtttatgcgaattattcagattcagcaatgattgattacattcaggtagtgggcttggcactttcctgtgtcattagttattcccacaacaactttgtaaaatatgtgttatctccatttcacagatgcacaaacaatgagtaaaccaagcctcagagatgctcagggaccaacctaaagctaattattgatagattttggactagcaacccctggtgtgtgtgtgtgtgtgtgtgtgtgtgtgtctgtttgtttttaccatgctgactgtttctgacatagtgctttaggcaattcactcagggtattgcacacattagaaactcaaaaggttcttactaatcaaggcacaaacgtatactgaacaatatgatgtactagaaacaactagctaatagcttcccacaactttagaaaagctacaaagataaaccaaataacagttgcaatagtggcaagtttaggacttaatctgttgaaggaggtatgacttcctcttatgcatgccatactgtgggtcttttgaactgggagagtattattaaaagagctggacaaaggcagaacagcaagaaacaggtctcagggtcccaggcctgggattaacattatgaccttcaaaaacaaaggtgaaattaaaactttttcaggccaacaatagctgaaagaattcatggccagtagaccagcataagaactgttaaaggaagtttttcaggctgagagaaaataacagaaactcatgtctgtacaaaggaacactggaaatcataaatatgtggacaaatataaaaaatactattcttattttgcaataatttaaaatattagtgatcatataaagcaaaaattataacaatgtaagatttataattatacaagtaaaatgtaagacaagaatagcacaaatgatcaagtgtaagattcttacataatatgtaaagtaaaatattaggaattataagaaaacaactaaaattaaaacagatatagcttaaaagcaaatatgaagacaaaatggaatattcaaatatacttaattactccgaaagaaggcaggaaaagcaggaatcaaaggagaaaaaataggagcacaagaaaacatattatagaataatttatttaaacttaaattatatcaataattaacattaaatataaatgagccaattgctcgaattgaaaggatattatgagactacatgaaaagtgagacctcatgaagtactattttcaagatatacactccaaatataaaatcacagaaaagttaaaggatagaaaaaacgtacaaatgctaatttttaaaagccaagttagctatattaataacacagacaaagaagccttcaggacacggagtattaccatggacaaaaagagacattttattatgataaaaatatcaattcatcaaaaagacataacaaccttaattgtggatgtacctagtaatagagattcaaaacacatgaaacaaaacttaagagaacaaaaataagaaataataagttaactcacaattatagttagagatttaaaaactcatttctcagtactagataagggaagtagaccaaaaaagaaacaaaaacccagtcctcttctttacttgatagtcaccaaagatcattctccatattatttaaatattttaaaattaaaattaaaatattgaattttattcaacaaaaattaaaatattgaaatattgaaatatttgcattagggccagtctgcaaatttctgaattagtttggaattaaacaacatactcttaagttatccgtaagtcaaataagaaatcctgaggaaatccccaaaattttggcaaatatttttaactcaatgataatgaagtcacaaatttgtaaatgcagataaagcatgagggaaacttacaccttttaaacttatattagaaaagaaaaaaatatcaaaaatcaattatcaaaagacctacttaaagaagcctgcattttaaaaaaaagtaaatccagtgagtagtaaggtggaaataacaaggatgtgagcaaaatttgatgatattaaaaaaaaagacaatagaataaagcagcaaaagcaaatgttagtgttttaaaaatataaatttatctgattctaactagaattattaaattcaagagggaggataagagagaaagaacacaaattatcaatatcatgaatgaaagaaagactatttctccattactctagtccttacagacagaaaaaaaggtaatatggaagtattataaacaatttttccctaataaatttgaaaacttggaaatcctgtacaaatccctggaaagaaacaaattaccaaaacctatacaagaagacattgaaaataaaaatattatattagcaaaactgaattcattaacaaaaattatttcattatgaaaatgctgttgcaatctatcaaacattttaggaagaaataataccaacatttttattaaaatataaaagaagataatctttttcattaaagagaaaagaaaatatgggacactttctaatttattttatctgactatcatagatgtaatattaaagctagacacatacattcaaggaaaaaaaaatcacagaccaatattccccattaataaaggcacagaattcaacaacaaagtattagtaaatttaatctagcaaaatagaaaaattgtaatacatcttagcaaagaagaagtgttcatcccagaatgcaaggttagttcaatgtttaagaaacaatcattttaagtctgaaaatagagtgaaggagaaaatttttatgattatctcaataggcacagattaaatttagccaaatttaattttaattcataataaaaactcttaacaaactaagaatggatagaaatttcctaaacttgataaaattcacctatagaaaaggcacagctaccttcacacttaatggaggaagactgaatcatttttcctgagactggcaacaagacaagagtgttattctaataattcctagtgagtactttactggggattcctaaccaatgcagtaagacaagaaaaagaagtaaaaggcatacacaatggaatgaaaaaagcaaaactgtcttcattcacagacagcacaattgtttacatggaaaattgttaggaatctacaaagtaactaaaataattattaagtaaatacagcaaatctcaggatgcaaaaaaagaatccattttcttcatatattctaccaacaagtatttttaaagcaaaattattaataatgcaatgtatgactgcatcagtaaacaaatctaggaaatgtttgtagcaactttatacatatcacaaaactgcaaactacccaaatattctcaacaggcaaaaagataaagatgttgtattacagctatacaatataaaactactcagcaataaaacagaataaattactaatattatatgcaacaacatggaggaatttgaaagctaatataagccagatacaaaatatatatgctatattatttgattcatctatattcctagtaccagcaaagctaacatgatgaaaaaaaacccagaacattggttgtcactggttgtttggtggtaactgggatagatttgaaatggacacatgagtgctacctaggatgatgggagggttctatgttttgacagggatgtgggttacacagatacttgtatttatcaaagttgactaaattgtacatctggtatctatgtattttattgtatgaaaactgtattacaatgaaaagaaaagaaaaatggaggaaaaaacgaggcagggagaaaaggagagagatgaagaagaggtagaaggaacagagggagagagaaaaaataatggtcctaggaactggggaggatgtgagccaggagcttggggttactgttgccaacagctgagaaaataggcgagcagagctctgaagggtcagtgtctcagttagaattttgtaattctttaaatggttaaactaaatcttgatacaaaaggaaagcatattttggggatgcaagatggaaaagataagctctgacccctgacttctgctctattggctttaaatagcagttggatttataaaagcctattctcagagattcgtttgtatagttttcttgttcagtttctttaacttggaatataaaagttgttccaaattgcccactgtatatctgccaaacttttatgtgaagaattgggtggcaggtgtttcattctgtagtcattcttagaagggtttgttcccatgtttgaatggagtcagttgtgcacttaccccttcccccaagctctcattgcagccttgcctgaaatctattcttctgaagtacagtggaatgttaacccatttataattgcaatgatcattcatttctctttctattgctttgctgtgccaagcacatgggagctaaattcttggcaaaagtctttttttgcttgtagtagtaggaagcagaacttactctgccctgaaatgtgcacagtggagggagatgaggaaagccctgtagtaacggaggaaggaatttctcaattcaacaattgttatataaaagtaaactttcactgcagctacactgaggtacctccagggtgtggcagcaaaatcagaaaaaaaaattaccttgagaacaagaaactccagaaactcaatatcaaatatatcaattcagactcataactgccctactgggcagttatcattaatcctttctatttcatatgatgaaacttatgttcaaaaatagatgctaaataactagtctaggtaaaaaaataatttctataggtgagattttaatttttgtgtatcaaattccacactgtactgtttccttatctcagattgttttatgactctaccccaaggatctagcacagtgcctggcactaaatagacccccaatgaatatgggttaaattaaaaacccacacaaaagttaacccctgtggtagatagctgaggacaatgccaagtttaatacatgtgtctctagagcatctcaattttctcaggattataggaaacatggaaagctgaaatgtaattaactaactatattatggaatatattgctttttaataagaagagtcatgtgtttccaagaatcactatttaaagaaatacttacattaataaatcactttaaaagtttctggcatgattaggagtttcaactactagacccgaactcactagctcagggacttgagattggctattcagtaatcaccaaagatatgttttataactctcatgaagttgtttgacctttatatagcaccaagacaactatcaccatggctgctgatgggtgtggcaggcaaatgactgacagtcaatcacatcctagttgagttaggcaagctcattcatggagggaccaatattaatcttttgggaggtttttttagtttgtttatgtgttgtgtttttgttgtctttacattgggccagtggtcttcaggtttcagtgaagtctctgatattttatgaaaacttttgtgaatataaatctcttatggtttcggtggagaggctttatagctttataaaattagtaatgaattcataataccaaaattactaaatatcattctaggccttacagttcaaggggtgccctcagaggctccatctctcaagtttcgctgtaatgaaaagagtattcattgtggtggaagctccatgcatggacgggaacacagatggcctcttctgataccttcattcattgcgtaagtacccactatcattttaatatcctttctctgatcacatgactaaagtatgggctaatggaaagctggtatcctgcagagtcgagagttattttcaccagaatgcaaaaatttgacagcgtatcttattcagtatggccttggacctagtgaccaccctcctttttctcttcatggaggtgttttactgggagatgttatttgtctagagtacacaataatgcctgtgatgtttcctgtcaataacccaaaatattcttgagacatctaaacatataaagattaatggtgatgattatgactacatgacattttgaaaaaggcaaaactatggagacagtaaagatgtcagtggttgtctggagtaagtggagacagacaacgaatagacggagcatggagaaattttagggcagtggaattattctgtataattctgtaatggtctatataagccattatatatttatcaaaacccatagactgtacagcaccaacagtgaaaagtgaatactaacataaactgtggaccttgagtgataatgatgcattgatgtaggtttatcagttgtaataaatataccattctggtgtgtgatgttggtaatgggggaagctgtgcttctgtgaggcagagtatatggagactttctatgcattctgctcaattttgttgtggaactgaaaactactctttaaaaagaggttattgaaaaaacaatctggcataatgggaaacaaggtactatgttatggtaaactgggcttgttctcaataaaactcaatgtgaaattgtggtaatcctgggttggaacatttgctatagccttgaaaacaacaaagcccttttcctcctcttagccaaaaatcaagatggcagaatgggtctttaaaaggcaggctttggattaccttatccatccaaattcatggaaggaaaatgtaggtaggaacaggaaacaaacccatacatatacaactttttatcacacagtgcccacaaaaagacctaatctgattaatgagagtaaaaacatcttggggaatgagcaagaaaaaaggcactttgaagatcatagtagatgaagagattggcacattcctttcatctagagccctgctcattaatattattccatccatgcacttaacattagagtttccaatctactcagaatgattgaattcctatacatatattctccttgtgaggagagaccagtgaaatgaagcagttcaattgttttgccaatttaattttttcagttattggcattccggtttatttatctctcttctggtaggagcttattcttatatatccaaaacccagcatggttcttgaacacagcagaaactcaataagtgtttttacatttatcctgaaatatagatattctaaacctctgcagagcagtgattctcaaaatgtggtccccaaactagcagcatcagcattacgtgagaatttgctggaaacacaaattactggatcccacccaagacctactaaatcagaagttctgagggtggggcccagaaaactcagctttaccaagtcctccagatgattctgatgcatggtaacatttaagaaatacttctttagagtgtagcctaatgaactaatgaactgaagttcttgaaccagacagatgataccataatgagcccaccaagttccgccttctgaagggcttgttgatggcccctgtaggctcacggggctgcagccctgccagtttgctgacttctaaaaggcctgacaggaggtgttttctgcggtatatcgaacacagatcagaatgtgacccttacaaactcagactaacctttgtcaaccctatattaccataggcattacctcaggaatgaattgaaatgatctaggctcagagaaaattatacgtaaacaagaatggccattttaaaatgtacagtgtgaaagacaactctcattgcatttcctctctatagtcagcctaacctgaagaagtcaaaaaaacttcctcaaaagcagacaaccaatcccagaaaagttaacttaattgctttgtgcttaaacaggctaaaataacaataaaaaggctaatatttattaaatattttctacgtgccaatcatggtgctaagtaatttacatacattctataatttaatcctcacaacagctttatgagttggatataatagtatccccatgttgtgcactagaaaactaaagggtaaagaggttaaatcgctttgctgggattacccaggtagtaaacatcagggaccaagatttagaccttagtctgtcttaaaacagagaaatactattaattacaatactgagctgcctgccataagaccaacacagccctccccaactcagggtaaccttgccaatagggctatgatagctacagtccctttgccaagacttcttcatcagatggcaaaactaaaatgggctctatataactttttttcctctatgtttctgttgcctgaccaatatccttaaactccagggtgcactttcttcaactacgtcaatatttcaatcacacgaaagtaagggtcttcagcaggagagccactgcatctctttcagataactttgtacatctttgctctaattcattgttgaacttactggttttctcttagagaataatctttttgccacattcctgatttcttaaagaaactcctattcattttccccaattgtcagttagagttcaaatccattgggcaaatttctataaagcagaaaccatggatggcatggagccaaatttctaccattttaataaactcttctctgcctccctccccatttccttaaaatcctaaaagtaaaaaagagagagaaagaaataaaagttaaaaccaagcacttcccatgtcccaggcagtttcatcttattatttcacctaagcccctgcctcccaccaggaatcctgtcaaagtaggcattactatctccagtttagaaatggagaaattgtggttcagagaagatagagttcttgaatcacttggatcaaagtatttctgttaccaaagcctgggtttgtttctctgctcacatgaaggtttgatggcttctgtagcctcacatgaagggtagatggttttaagagattgtcagaaggtcaactggagagcaaagggaaatagcctttcctgtaccccattatattcttgtaatctcttccatttgatagtttgtctgcctactgaacattttgacagactttgcatcttctgtgacttttaaaagtacaagtaggtagcaaagtaagacatccagcaacatccttgatttgcaggtcaggaaacaaaaattcagagatgttaaatgttttagctagggtcaattatctatgaaaggtagaaatgatagccgtacctaaatcttctaattcctgagtcaatgctctgacagctacaccatgttccaggacacatggttctctagttgccaatataacaggaaggacaattcacggaggagcccaatatggattttaagaggtaacaagactgtgactgtagcatgaagttacccccaaatattccgaaaaattagtgttggtgtcccaaatctcacacaattaccaaaacagagaacccattctctggttgtctttgaaaaatacaagtttttaaggaagaatgatcatgaaaaaagctaattagaaggggcctcaagatggtcaactagagacatttagcatttacaacctccacaaattagaaccaaaatagcaagtgataatcccactttaaacagaacatttaagagagaacactggaattccacagagcaatgacaggaaatgactgaggcatataaggagagggaaatgaggtagacatattggccaagatgagctgggaccctggagaggctccccagtatggggaaaattaagtaacagaaacatagtgattcacatttccaccacagacttcttcaaccctagccatggaagagcctttcgaccttcacaggccctgagacttgcataaggagctgcccagagactgcatgatgacagtgcctcagagagtgagcccatgctgggtcccatgcacccctgagtcctaagaagctgatgcatggtgccattttgagatcccagctcccaccagtcttcatcttgccctaggtaccaagagctcctgcatctgcacatctttagagtttcactgacatccccacatgtccacccagagggctgtagtggcatgacgctgattgagcccagcatagtggcagggctcccaacaccctagcatatgtagtatcttgtgctctgggtaacaggtggtgcagcacactggggaggctgccccaggacaaagggagccaaagcacatgctcctgagagcttgaaaccctcttggtatggctgctgccactgacggcaaccccgctgtcaccagaagcagggccacagcacccttgcctgtcccctgagtactggctctctcgactactgtcactgccacagccaccgctgttgtcactgggggctgaagtgcatgcttccccagagactgagagccacctccatgcaactgctgccactgaccacatctctccccacccaacccctgccagcacatacatgtgccctgaggacagaatcttcctgcctgctgccactgtcactgtcaccatttgaggccaaagcatgtgctatggcagttgcctcacaaccccatcagcaggactaccccacacatacatgcaccctgagtactgactgtttctgctgctgccactgccatagcagcagaagtgcatcctccccagaatctgacagctgcctgcctttggctgctgccactgacagtaacccactccctaaggaccaaggctgcagtgcacttatacacaccctaaggacatgccttccctgcccaccaccactgttggaaggcctgtgaatcccctcccctgcctactaaatctggcatctatgcacaccactggggtccctgaggataggcccagtgggcctggtaccatgcttcccagtgcataagcatgccacctggggacctggagatcaccctgccctatcctccaccagcggcatctatacactactcccaggagcctgagtatgggcccatctagcctgccagacccaccacagtcagcaaccacaaacatgtaccacctgggggcctggagactggcccatccaacacatcgcagccaccactaacaccaaagagtgctgcttaggagcctgaagattgtcctgccaccactactgtagtcacccacgtcacatacactgtccaggggcatggaatccacccattactgccactgttggcacttaagcaagtcaactgaaggtccaagaattatcccacttggaccttttaataccaatacacatgtaccctgcccagaagcctgaggacaggcacacttggcccacagcttccacaactgaggcctgaggactggcccatctgcatccctgtcctcagcaaaacctcaacacaacctccattaacaactgcagcttaagccactgaagaaatcatgaacacaactgacactgcttcgagctaaagaaatcatatggagactacactactgcatacaccagaatcaaagctaaagtgacctacccaaccaacagcatatatatatcttcaggagaaagtattctactacagtagccaatccaaaaatgtagaagtgactactatatcagttcaacataagaacacaggaacatgaaaaaataagtatgatatctccaaaggaacacagtaattttttgcaacaacagattccaataaaaatgaaatgtatgaaatgccagaaaatgggctgggcatagtggctcatgcctataatcccagcattttgggaggtcgaggcaggcagagtacttgaggtcaggagtttgagaccaggctggccaacatggtgaaaccccgtctctactaaaaatacacaaatttgctggatatggaggtgcatgactgtaatcccagctacttgggaggctaaagcatgagaatgacttgaacctagggaggtggaggttgcagtgagctgagatcatgccaccgcactccagcctgggcaacagagggagattccgtctaaaaaaaaaaaaaaaaaaaaaaaaacacagagaaagaaaagaaaaaaagaaagaaagaaatgccaagaaaatggatttgaaataatgatactaaagaaaatcactgagatacaagagaatgctgacaaggaatacaaagaaatcagaaaaacaagtcaggaaatgaataagaaattcaccaacaagataaatgtcataaaaaagaaccaaacagaaatcatggaacagaagaattcaatgaataaaataaaaaatacaactaagagactaagagcttcaacagtagactagatcaaatagaaaaaagaatttcaaaatttgaagactggtctcttgaaataactcaatcagattttttttgaaaaagaaaaaaaatgacaaaagttatgtgacatatgacaccccaaaaagccagtaagtattgaatttttggtattctaaaggttaagagaaggccaaaggcatagaaaatctgtttaacaaattaatagctgaaaacatcccagacaagatatttatacatatagatagaggaaactcagagattaccaaatagaaacaacctaaaaaagtattttccacagtgcactgtagtcacactgtcaaagtcaaagagagaattctacaaacagcaggagaaaaacttctagttatgtataagggaacctccctcagactaacagcagatttctcagcagaaacattacaggccaggagtaaatgggatgatatatttaaagtattgaaacaaaaaaagaaaaaaactatcatccatgaatactatacttagcaaacttatcattcataaatgaaggagaaataaagtatttcccaaataagcaaaaactgagggaattcatcaccactacacctgccattctagaaatgtgtaagggaatcctacacctggaaataaaaaggttatatctaccatcatgaaaacacacaaaagtataaaattcgctggttgaccaaacacacaaacaaggaagagaaaggactcaaatgttaccataacagaaaacctacaaaccacaatgataaaaattaagaaagaaaagaacaaagaagagtaagacaacaagaaaacaattgacaaaatgacaggaataagtcttcacatattagtaatagccttgaatgtaaatgatttaaatttttcggttaaaaaatacagactggctgaatggattttaaaatgaccctattatatgctgcctaaagaaactcacttcacctgtaaagacacatatatgctgaaagtaaagaaatgggaataatattccatacaattggaaaccaaaagctagcaggagtagctatacttatatcacataaaatagcctttaagtcaaaaatatttaaaaaacacaaagaactcattatataatgagaaaggggttaattcaacaagaagatataacaattctgaatatatatgtatgcaacagtggagcaaatataaagcaaagttattaggtctaaagggagaaatagacttcaatacaataatagttaagaatttctataccccactctcagcattagagggtttatcttgacagaaaattaacaaacactggatttaaactgcactttagaccaaagggaccttacagtcatccacagaacattttatccaacagttgcaaaatacacattgttttaattatcacatgaaacattctccaggatagaccgtatgttagggcacaaccaattttaaaaagtcaaaattatatcaaatattttctcagaccacaatagaatgaaactaaaaattaacagaaaagggatctttggaaactgtataaacacatggaaattaagcaacatgaccctgactgaccactgggtcaaggaaaaaattaagagatatcaaaaatgtcttgaaaaaaatgaaaatggaaacacaacatatcaaaacttatgggatagagcaagagcagtgctaagaggtaagtttatagcagttactgtctacatcaaatagtagaatgatttcaaataagcagtccaacaatgtacctcaggggctagaaaagtaagaacaaaccaaaccccaaattagtagatggaaataaagtatataaagatcagagcagagctaaataaaacagagacaataaatatatataaaggatcaaaaaaagaaaacgtgttttcttgaaaagataaactgctagatagattaataaaaaggactcaaataaacaaaatcagaaatgaaaaaggagacattataactgataccaaataaatacaatagatcatcagaaattattatgaacaactatacgctaacaaactggaaaacctggataaattcctaggcacacacaaccagtaagattgattcaaatgacatagagaacttgaacaaaccaataatgagcaaaaagattgaatcaataataaaaagtttcctgacaaataaaagtccaataccaaatggcttcattgccaaattctaccaaacttataaaaaaagaacaccaattgccctgaaactattccaaaacattgaagaggaaggaattctcttaaatccactctacgaggcctgtattaccattatactaaaagtacacaaagacacaacaacaaaaaagaaaagtacagcccaatatcccggatgaacacaaatggaaaaattctcaacaaaatagtaccaaatttaatttaacagcacatcaaaaagataataaaacacgatcaagagagatttgttccaggaatgcatggatagtttaatgtatgtaaatcaataaatgtgacacgtcacatcaatagaatgaaggtggctcacacctgtaatcccagtactttgggaggcgtaggcaggcagatcacaacatcaggagatagagaccatcctggctaacatagtgaaaccccgtttccactaaaaaaaaatacaaaaaattagccaggcatggtggcgggcatctgtagtcccagctacttgagaggctgaggcaggagaatggcgtgaacctgggaggtggagcttgcagtgagccgagattgtgccactgcactccagtctaggcaacagagcaagactccttctcaaaacaaaaacaaaaaaacaaaaaaaaaccctgaacagccaagcaatcctgagcaaaatgaacaaagctggggacagcatactacctgacttcaaaacacattacaagtctatagtaatcaaagaagcatggaagcatgctattggtataaaaacaaacaggtagaccaatggaacagacattgtctagtcaacccagaaataaatctatgtatttacaaccaaagatttttgacaaaggaattaaaaaacatacactggggaaaaaaacaccctcttcaacaaatggtagtagaaaatgtggacgtccatattcagaaaaataaaactcaacctctatgtctcaacatatacaagaataaactaaaaatggatcaaaaatttaaatgtaagacctgaaactataaaactattagaagaaaatatagggaaaacactccaagacattggtccagagaacgattttatgactacaacctcaaaagcacaggcaagggggccaggcgtggtggcccatgcctgttatcccaacactttgggaagctgaggtgggtggatcacctgaggttaggagatcgagatcagcctggccaacatggtgaaaccccatctctactaaaaatacaaaaaaaaaaaaaaaaaaaatagccaggcattgtggcacatgccttgtagtcccagctactcaggaggtggagatgggagaattgcctaagcccaggaggcagaggttgcagtgagccaagatggcaccaatgcactccagcctagatgccacagccagaaacttgtctcaaaaaaaaaaaaaaaaaaaaaaagaggcaggaaaatcaaaaagtagacaaatgagaaatgagactatattaaaccaaaagcttctgcacagcaaaggaaacaattgacagaatgaagagaaaacttattgaatatgaggaaatatttcatctgacaagggactaatatctagaatatacagggaactcaaacaactcaacagcaaatattaataattccatttaaaagtgatcaaggacattaatagatatttctcaaaagaagacataccaagggccaataggcatatgtaaaaatgcttaacatcactaataatcagtgaatccaaatcaaagtcacataaagatatcttaccccagttagaatggctcttaataaaaagacaaaaagtaacagaagctagcaaggatgcagagaaaaggtactgttggtgggaagtaaattagtacaacccgtatggaaaacagtatggagatttcaccaaaaactaaaaatagaactaccatacaatcatgcaatgccactacttcggtatatatccaaaggaaaaaaatatcagtataacaaagggatatctgtaccccccatgttaattgcagcaatattcacaacagtaaagatatggaatcaaccaaagtgtccatcaatagatgaatgataaagaacatgtggttacatacacgacagaatactattcagccataaaaagaatgaaattatgtaagttgcagcaacatggatggaactggagtgaaataggccaggcacagaaagacaaatattgcatattctcactcacatgtgggagctaaaaaatgttggtctaatggaggtagaaggagaatgaagattaccagaggctaagaaaggtatgtgtggacaaacatgaaaacatccagttggatagaaggaataagttctactgtttgatagcagagtagaatgactacacctaacatcaatgaatcacatatttcaaaataactagaagacaggacttgaaatgctctgaacaaatagaaataataaatactcaaggtaatggataccctaaataccctgacttgattattacatattatatgcatgtaacaaattaccacatgtaccccataaatccttataaatattatattaatatgtcaataaaaaattcttaaaaagaatcatcatgaggaaaaaagctttctatttccctcatttccaggactttttcacaggcaggatgagcagaaaaggaacctggtaccaactgcttctaacaaagctatgcatatagacctaattctacttgctttttctctttaaaaaaaagtccatgctcagaatcacaatcatagatgtctcttggttaggaggttacttgagtctttaggtagcagggagcatgccatttttctttatactcttggcattcattcaggctcccaggggcaagttagtgaccagcaaatccagtaaaaacagaaatcgttacctcataaaacaccaagagactttccaagcctcagggagagtaacacccctgccctttctaattcacagaccacattccaagtgcaaaatggaatcatttttgttttcaaagtgatgctaatttattagccatggtggaaatgttgactatggtaattgacttcaaacagaatatcttcagtccagagagcttgaggcgaaaagggaagtcagtagggaggtgaacagaatccagtagggttctccagaccaaactgactgcactcagcaattcatccactcactttcctcctcattaattcttttattattgacctactagattccagggacttcctaggtgctgggggtatacagctgttaatatatgaactgttttctcatagaaatcatggttgagtcaggaacacagatgagtaaacacagcatcacagacaagtttgtttccttcccaatggaagcacgtactaagaatgtgggaaatgtcagaaaagcactgcaaaagggacaatgtcaaggaaggcatgagagagtatgagaaatttgaaggacgatgaatcctgaagtatgacttacacgaatttgtttaaataaaacctcagatcatacaaggaataattaaatatatgttagagaaaatctcaaggtgggatgagacaatttcacaagggcctcaaattttattttgggtgtttttccttcttaggatctcttctaaactgtctccttggaggcttaagtaagtaaaagtctttataactcagggttcttaattacttgtgaaagaaacagagtctggctatcttaagcagaaaaataatttactggaaagttattaggagcccatccaattgacagagcttggaagagcagacctggaaaacaaagaggagccagaggagccacagaggggcaggtagtagaagcagagcaatgattgaccgggagcaatctaatcttgcccaaggccacacagcagcaaagtatccctgaggccagcaatgctctaggtaatttctaagcacttcttactgggggctctgttgtgaacacctaccattttttgactgtcaataccctctttcctatttgaattgttttttaacttgattatcttttaattattttcaaaactttagtgcaatacacataacataaaatttaccatctaaaccatttttaagtgtacagtatagtggcattaagtacattcacattgttgtgcaactgtaaccactatccatctccagaactcttttcttcttgcaaaaccaaaattctatagccatgaaacaataactccccatttcctctttccccagtccctggtgaccatccctacttgcacccttatctttcttttggggaactccccaagttgtgtggtcctggaggaaatggctgcctctcattccagatctccctttccttgcccagattggccagaagaagacaggtgaccgaagtgcagtcaattcggtgctctctctcaagagtttgtgttttcagtagagatgcaaagatgtagagtgggttggagacatagtcacagaaactgcaaggacatgtggctgcccaacatcacacagcttgttaagtggtagagccagggtatcaacccaggcaatctgaaaatgagaaccaacaaagctattgaattagagagccacttttcagccatttattgaacagaaagtgcagtgaattttttgcataatacatcatatgtatagaaaaactatataaataaatttcttgctcttaaagagttctcttaagtggggacatagagtagcaattacagtgcagtttgatggtcatttctataagatttgataagaatatacaaaaagaaaattttaagttggctttaaatgtgggaaagaattctcagagaacttagttattaagccagatcttgaaggttggtaataagtgtgccttccgggcaaaccccagagagttcagtatatgcaaaggcattaaggcaagagaggccttattgttctatgaactacaaaagatctcagaaattgctaaagcatgaaatgagagataggacatggccagaaagcactcaggcatggactggcaatggagaagggcctctcatgtcatacaaggaaatattattttagtcttccaaggctaggattataaatagggagcccttggatcctctgtgagttcatgagaaatcacactgaaataatatcaaaatgtttctggtggacattttacttaactgtaacttctatcatcttttcatggtggtgggtagaatctggggagttggtagaagctgtagctcttctggctcctctgtaaacttaaaaaatgtactttttccattggtagttaacaatgtaatcttcatgttagcaaaaccatcattgttagcacttccactgggttgcaggaagagagtgcatgaggatgaaagatggaaagaggggagtgtgaaacggaaggagattgttgggttttttcccctctaggagtagcagtatgctgattgtcaataaaatgagttcatcttgcatgctaatgcaccaagtgtcaggtgaataaattatctcttattagactttaccatgaggtaagtacttttgtccccttctttcttgggtaacaccagttgtcacaatgcttatcaacgtaaggaaacttggacctcattaacatggaaggaagggaaaatgtgtgagagaaatgcttgcacagagagtgattaactgtaaaaagatctttgttagagcacaattgtttaaaactctgtctataatggtggggtggtagtaatatttgtctttcctttccagttttcttataagatttaaggtagggaacattagagtatatttttttcctctctactccctggcacatcgaaacattcagggcatatagcaagttatttaaaatggtataccccactaacctgaattaaactaaatcaatttagcaaatcacttatcaaagaagtagtgagcatcctgttaattgcagggatagtaagacctccctttctcaagaaacttaaagtctaaagtgagatgaatctttcataattgataatagtacaaataagaataaaatatacttcatagaaaaagacaacataatttggtgtttaagatttcagctgtttgagttagataagcctggtctagaattctggccctgaaccttaataacttcatgaccttgggcaagttatacaatcccccggatctcagttttcttatctatgaaatggaaatagtaattctacgctttttaaaaatttgtttgttctgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattctctcccattttgtaggttgcctgttcactctgatggtagtttcttttgctgcgcagaagctctttagtttaattagatcccatttgtcaattttgtcttttgttgccattgcttttggtgttttggacatgaagtccttgcccatgcctatgtcctgaatggtaatgcctaggttttcttccagggtttttatggttttaggtctaatgtttaaatctttaatccatcttgaattgatttttgtataaggtgtaaggaagggatccagtttcagctttcgacatatggctagccagttttcccagcaccatttattaaatatggggaatcctttccccattgcttgcttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtaacatgatgcctccagctttgttcttttggcttaggattgacttggcgatgcgggctcttttttggttccatatgaactttaaagtagttttttccagttctgtgaagaaagtcattggtagcttgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagtttgattcctaggtattttattctctttgaagcaattgtgaatgggagttcactcatgatttggctctctgtttgtctgttgttggtgtataagaatgcttgtgattttttgtacattgattttgtatcctgagactttgctaaagttgcttatcagcttaaggagattttgggctgagacaatggggttttctagatatacaatcatgtcgtctgcaaacagggacaatttgacttcctcttttcctaattgaatacccttcatttccttctcctgcctaattgccctggccagaacttccaacactatgttgaataggagtggtgagagagggcatccctgtcttgtgccagttttcaaaccactatgagataccatctcacaccagttagaatggcaatcattaaaaagtcaggaaacaacaggtgctggagaggatgtggagaaataggaacacttttacactgttcgtgggactgtaaactagttcaaccattgtggaagtcagtgtggcgattcctcggggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcacctcctttgtagggacatggatgaaattggaaatcatcattctcagtaaactatcgccagaacaaaaaaccaaacaccgcatattctcactcataggtgggaattgaacaatgagatcacatggacacaggaaggggaatatcacactctggggagtgttgtggggtggggggaagggggagggatagcattgtgagatatacctaatgctagatgatgagttagtggatgcagcgcaccagcatggcacatgtatacatatgtaactaacctgcacaatgtgcacatgtaccctaaaacttaaagtataataaaaaaaaaagaaaaagaaaaaaaaaaagcaaaaaaaaaaaaatttgtttgttctgtggatttaaagacacactgtatgtgaagtatttaacacagtgtgtgcttagtaagatacttccaactggttaaaatggctaaaaaacacaggaggttcaagaggagtaggccatttttttctgagtagtagcatagagaaatcttagccaaggaggtagtatttgacctgaaccttgaaggatgaggacaattaccttagaagaataaagtgggaagggagaaaggcagtaaggcctagaaaaatgcctggagaggtacaagtacatgtcaaagatgtggggaatagaatataaaccagtatagatagagccaaaaaacatcactgtatgaggaatagaaagttattgaagggaggtggaactggaataagactcaactaaaatcataagcaacctccatgccttgataacaagcataactgaatgactgaattaattaatttatgctacagttaatgatgcaacattaaaatctttgttcaaatacatttttagaaagattattctgatggcattaagagggtatggctaacccaggaagcacaactgaaggtataaagaaccttacattattccaggtaatagataatgagagactgaactaaagtaatgacaacaggaatgcagacgtggggacagaagaagagataactgggggtgaaggaactaacagtataaagagattcctcaaaattggtgcctgggtatttaaatataagaaataattattgccaattaaattattatttttcttaatctatcatttatggacatgtatataagcatattttttattaaaaatacatcctgtgtccaatcaactacccaaatattagattactgctaaataacaaaccagctccaatacttaattgcctaaaactacaaccattttatcatatctcattattctgtgggttgactgaactcagttcagctagacagctctaatcacaagatgtcggcttgagctgtagttatctgggtcttgactgggctgcaacatccaagatgggtcactcatgtctggtactgctgctggctgtgagctgggagctcagctggagatgttgaaggcagcacctcattttctttcacatggcttccccatgttgtttgagctaccacaagaaaggaagtagaatatgctagacctcttaagtcctgggcttggacttccttggttaccactctaaataccttctctttggcatggccagtttcaagcatagtcaagattcaaggagaaggtaaataagtaccacctcttgatgtgaagagcagcacacacacacataaggagggaaagattgtttggggccatctttggggacagagattggttctcaaatgattcaaattgaagaaactggcttgaaaatattctccctttctaatgactagggatccaaagtccacatcaaaatataattggtcattatccacttatattcttgggcaatctcctctagtcccatgtatccactatttccaatgctctggtcattgctgaaatagtattttctcctgagatctagactcttatacacaatggctctttcaactggatcttccacagacagatcaaactcttcaatatgcctaaaccaaagttatcctcctcctcctcttccattctgaacaacccacccctgaaagaatccactatgttttcctcctgggttttttgccttcatgcatggtgcttctgttcacccttctgtctgagtcagtgcttctcaaactttaatgtgcaaagcgatcacctaagaatccacttaaagtgcaaattctgatttggtacttctggagtgaggcccgggattctacattttaacaggtttccagatcatgtcaatgctgcttgtccatgaggtgtaaatgtcaaagtcacagaatttgagtttatgtaaaacattgttgcatctcccttttctttcaaacaccatcagtcaccaaatcttgtcaattattccttctaaatttatctcaaatctattccttcctgacttctctaatctcttttatctagtctggtctgagcaattgcagcgagctcctcacttagctatctggccccatctcatctataatgtatcctatagagtgttttcaagactatctttctcatgcgaaaatatgattatgctactaattgtctctgcttcacattttcccatgcatcctgcagagtaagaaataaactcatctgaatatcgtgcccctacttttgtgctcagccttgtgccctgccactcctgcaacacttcactttaacttcccctttcccccacccccagcacatgtgcacacaacacacacacagtctgtgccacagaacacagagtgatctttcctaatatcctggccttgctacatgctatttccctacctataacgcaactcatcctttaaatatcaattaaaatattctctacttcaggatgtcttctctgacccccagggataagttaagaactctttctcctaaatgctcattgcactttgtaagtaccatcactaaaagcaatctttcttggttgttgtttgtttccatgtttcttttcccactaagccatatgacctttgagagcaaaccacaacttcccaactttgtattcctgatgactagccccaactcaaaaatgattatgattgtacatagtaataagtaaattaaataagtgaataaacatacatcaacatttgataatatcagtaaagttagattttagtccaacacaaaaaggaattttattgcaactaaatcttttgtgttctttgtgcagtaatgtgcttccctgccaagggaaaaataggcagtcatcatataaaaggaaattctaatttgaatgtatattttaactatataacttttcaacttccttccaattatgagattatatgatgtaagatgaatttgagaaggatgttcatttttgaatgatttctagaccatgtaataatttccttctaaactattataggaaggactagaggaaattccagatttgtgacacatagagagatagcagttctatctcccgtattttcaactgtatgttatttaaagttccttgaaacaaatttcaattatcaacatttccctgacatatcttccactaaaacaaaagttttccagctcagcagaaagacccacattcctgtagtttcaggaggcagggtgatgtggacttgatttttacttttctcatcaattctattctgtaagttttgtaagaatctttactcttcaaaacagctaagaagttgttgccagaaggaaaaacagaatttatgaaatcacagtctcaaagaacagaagatactctcaagagacacttttttaatttgggttatgacattaaatctattataatgaccacttttaggctcttcttcataggaaaaactgcagatttccttccaatttgatatttgaataattattcatcagtcattaggtttaaaaacatcatggctaactgaactctctcaatttatttattcaacaattataccaaaaaattaagtacttaaaaattttacttattgtttgatgtacatcatgaggatatacaaacaagacacaagtcttgccaagaagagatcaaagccagtttgttaaatggcaactcagggacaactacaaagtcttcttatactagttcactaagagactaaatcaatgaaaggctctttcaccacattaatttttttttattttacttttgtccttgatcatttagatgattgaatgtgctttccctttattgtgtgtctgtgtgtatgttattttaacctctgtctagtagtgtgtattagtcagttcccatgctgctaataaagacatacctcagacagggtaatttataaagaaaaagaggtttaatggactcacagttccatgtggctggggaggcctcacaatcatagcagaaggtgaaggagaagcaagacacatcttacatggcagcaggcaagagcgcatgtgcagaggaactcccgtttataaaaccatcatatctagtgagacttattcactattacaaaaacagtatgggcaaaacccgcccccacaattcaattacctcccaccaggtccctcccatgacacctggggattatgggagctacaattcaagatgagatttgggtggggacacagccaaatcatatcatggtgtataactgccctccctataccttcatctccggattagccacagagatcttttgacaattactttaaatggagtctaggagagtttaccacagacatgttttctccagggcaaatgctagaccaggggcaaaccaaacatactgcaataatttggtgagttaatttttggtgagttttggaaaattgaattttaagaagttaacattatagctatcatcaaggatctcaccatttagtcaaaagaaacaaaggaataaaccaataagaacaacagaagcatgttcctcaaagtgccatccctgcatcattattcacaatagccaagatatggaaattaagtgtctgtgtctgtgaacagatgaatggataaagaaaatgcaacagacagacacacacgtacacacacacacacacacacagagagagagagaaatattattcagccttaaaaatgaaataaattcctaccatttgtgaaaacatggctgaatctggaggacattatactaagtgaaataagccaaacacaggactataaacactgcatgatcttacttatatgtggaatctaagaaatttgaacttagagagtagaagtgtgattacctagggtcacagggtggggaaacaggagagatattggtgaaaggatacaaactttacatatataacatggtgactatagttaataacattgtcttgtacccttgcaatttgctaagaaagtggatcttaagtgttctcaccacacatatacatacacaaatgtaactgtgaagtaatagatgtattaattagcttgattatgatgatcatttcacaatgtgtatttacatcaaagcctcactttgtacaccttaaatatatgcaacttttatttgtcaatcatactttaataaagctgaacaaaataaaaataattttagattttttaatttaaaaaaagtgtggtcccctaactaacagtattagcattcttgggcagagtgcaaattctaaaggcccacctcagatctattgaatcagcaactctgaaaacagggtccaacaatctctggtttaacaaatgtcctccaagttattctgataatagccatgtttgagaacccttgtgataaggtttgagaaatgttttggtagagggacatttcagagcactgtatggagcccaggaggggcaattaacccagcactgagaactcaaggcaggcttcacaggaaaggttagcacctgacaatttttatcattgaattcaccttcttctagtcccttaaattctgccaggtttgctagcaataatactatgtgatttgagtttcttcataagttgcttctcttgactactttctggtggctttaagaataatttgaaacacaggaaacatgaatttagtagcaaaaaaaaaaaaaaaaaagagaaaaatggagctgatgtagaccgtattggaataaccaatgtttctttaatgccacaaatgcaaaaagcttaggctttgggaccaattaaccctgagttaaacttgtcagatatggaaaataaaaacataacatgtacatgtccagttacatctagatgtcaggaaaaaatgaatagtttttagtataaatatgtgccatgcaataatttggatttacttatactaaaaaattattctttttttttacctgaaattcaaaactgggtgttttatattttatctggtaaccctatcctggattcaagtcaggaaccactattcatgttttactttaaattggaattaataacaataacagaagatatttattaagcacttcctgtttaccaggtattatcaaaagcatatgatagcattatcttgttaaatcctcacaatacacttatcaattaggtattattattagtctccttaaacacataaggaaactggggcttagtggttgggtaatcaaagctagtagaaggtagagccagaatttaaatacatatcaaattccaaagcagggacaaaccaaagatactgataacaaatctgaccgcagaatcaaagcttttttaatgactgcattttatggcctctcttatacttcaatttgtttaaaccttgtgaatcctggtttcttttcagtttttgtgaagattaactgagattatgtactgacctaacccagtttgtgaccactcgtaaacacataaaaatgtatacttattaataataatatttatactcataatcaagaaaactgacctaaaaacatacttcacttcagaacaatacttccactctaagtaatgagttttaggaaacaagagctctggtttatctgggattacagacttatgttttggcctgaggtcattaaggatggagttaaagttaaataatgtgtatcttgtcagggagttgactttctggtctctatgacagaagaaagcagtatgcctccacagatgccacagtcaatggacaaaaagtgataccatggagtattattttgactcctaagtgactctgagatcccaacggccatagctactctccatggaaaaggtgagagctatgaatgactgtatggacaaggagtggcatgaccaaagggtctacctacagaaagaatgagaggagataataggtgtggtgtcaaaagcaggaggcttcgagtgtcctgcttcattagttgtgtagaggattaaaagaaaggatgtacataaaatggttcacatggtgctcgtgtacactacatgctcaacgaatagtgtgtattttaattattattaagattattattactgaaataaagaaaacattctgtctgcaaaatgaacttctttttaaaacaagaatcatgagctcttccaagtcacaatagtctcaagtgagactgaaataataggtctatttatgatgtagtatttgccattctaaaacaaaaagaaaaataagaactcttgttcccacttttctattagctgctattaagaactttgaatggtctaagattttacttcacttgcaaactattaagttagcctgccacaatttcatggatgctggtagaagacatgagacaaagaacagtttgttactcaagcgatatcagtagccagagtaccagcaatttttccgtgggttcctcgagcctccgttcccacaatgtgacaagagggccaaaagtcacctgtacatgtggtggattgtgtgacaggagaggaaaacgtagctgagagaacccaaatatttttaaatgggtgttaaatgtacttgccctttctccaggggagcaggaagcatttcctttattatactggacagtgagcacctctgccctttactccagaggaagatgctatttctatcctccaaagctgtgatcagaactgtactttgctctggaaataatacaaactttattttctaaaattttctctaaacaaacatccttgaaaatatagtccagaacaaaaagcacccaaataagccataaaactagggtgatgctccatgttttgccaagaagagacgcagcatgatttcaggtggctcttattatgagataatttactgcctgcatgcaatcttttaggataaaataatgcaatgaaggacgctttataaattgcagtcttgtgtcctccctgactcttcctaaaacaaatgtatgtgaaagaaatatactccttgggaatatataagataatttttaataaaagccaacaaaacttacttgacctagatagccaaattctattatgagctctcaataacattttgtatcttacccttgtagttttaatcacaattgtaattaattaggcatgtatttaatttattattcaatttctatcagttctcctagattgtaagctttctgtttctgagcggtctgtgtttctttctttttaagctccatttttgagttgcctagcatagcatctgctatatggtaaatatgcagtaaatacacgcaaaaaattatgttgactgaatttcacttcacatataaatgaagtatgaaaatttgacttcaccagggtttccagaaatctgatctgaatttcatagaagactgtcctgggaggggtaatgacctaagagattatctcggatccactttatttcaaaaatgaggaatccgaaggccagagacagcaaatgaattagccaaactcactcagccagtaatgaaggacctaggccagaattcaagttttctatctcttggcctaatgctctttcacctgtcatttcttcacctgtcccttcaacctcttgtgacaaagttttaaagcacacaaacatctccacagttaagatcctagaaagccatttctgtttctaatacgaaagaatgtgtgatattctacttaccttgcaggctcccaacatccctgtgatcaattgctcctccagaagccaactgtgacaaagatgttgctttgaaagaaaggtgctctagaaatgtaataaataaataaatgcatggactaggcagaacagcataggctctggattaaatagaagcaaacatttggtttttaaatttgaaatgaatgtggactagtctcagtcttctaccttgggaagagccatgaagatttatttttgtgaacctatcacaattctcattctcatgcagctattgctatcgaaatacctgaggtgagattgttttatggcctaacaagagcaaatataggtctctcttgccttactggctaagtggtttcacactcacttctgagcaatgaatctcagttttctagtgaatttcatgaaaagatttttagagctataatgctgcagagcaaaaatttccaccataggctgaatggaaaacttagaaagaggccagccatcgattttctgagggatactggatggacattactcttgaaatatgtttcagcatctagtattccagtccataatttctcacagtgatattgctttcctgtattgaatgtgacttaagtctgcattcttatattcccaatttaactcaactccttctttggaattaggattttaatatgtaatagtattatactgtattataacattttgctagcaagttctatcattaatccatattttaccccttcctagccatttaagtctaagagtttgattcctagaatgatagtactctgttggtcctttttaacaaatgttttctttatctgcagaaaagagaactgtctcactcttgtatgtcataacttttagagtatttagaagccgttataaaatcagccttggtttgtggattgtaccaatgtcaatatcctggttttgagggtggttctttggttatctaagacgttaccgcagggagactaggcaaagggtgcagcgggacctatctgttctagctttaaatctttgaaactttctgtgaccctcgaattattttgaaatgaacagtgaaagtaaagaagagatctggaattagaggagtagaagcaggagacaaacatttgagtgacaaacctgactcttgtccattggatacacaacctctgttttgtatgtttgttaaactataaaatggagaatgcatctggcagtagtaacaattaaatgagattaagtgtaatggcttgttcatggagaggcaatatggcattataattaagatcctataatgccagactgcctgcatttaaatccagttcatgcaatttctatgtgtgtctttggcccaggaatttgatcttgcctcagtagcttaacctgaaaattaggatgagatgataataacatcacttattttataaagtatttgtgataattaagttggttaatatatttaaggcacttagaacagtgcctggtacttagcaataccgcatgagtgttggctatattgttaagaaatcacttggcacatagcttaataaatgttagtctttttgtttttcttttctaattctgagttaaagcccgtaggcagccatcagagtagtatgagtaaaagaattgtgatatgctgacacaatgtatactatgaagtaatgaatgaacaatttccactacatgtaaaattttggatgaatctcacaaacataatagcaagtgaaagaagtcatccacccaggagttgcttgatgtatgattgcaattccataaagtaataaataggtgaaataagacttttgcttctgaccatgttgctgtaactggtgctgaaccagccctgccacaaaaataatgaacacttgcaaaaaatacagaacaactgttttcacatatcaggcagactattgcctagactttgcctgtaactggtgctgaaccagccctgccacaaaaataatgaacacttgcaaaaaatacagaacaactgttttcacatattgggcagactattgcctagactttgtaccctaagagaaggtaagccttaagtttagcccatatttctagctctgggcacttttcagaccctggtttagaggaggagagctcaaaaagtgtttgacaatatcactaagctaacgatgcagaaactggagttcaaggaggcacaggtagctgggatcagagtgaatgggaagaggaagctgtgcagagaaaaacttcaagaaatttacatagacttccacttgagccattggctgaattttaagcttgtaaaacataagcaagatcccatgagccagggtgaagaacaactactaaaaaagaacagctaccagaaagctataaattgaactacaagagctcacacagggttggtagatgttctaattcttatcactttgtatgaagagagtttattaacaatccacatcatacagtagaaaccaatgaagtttactttttaggaataggactaatccagccccagagtaaagacctgttaaaactagcacaaagaaaattaaaaaacaaacgccaaaaatattgagataatctgcaaatgaattgcctatcttctgaaataaattgacacattgtttaaaagaaaataacaaaatccaaacaacataaaaaatacaatgtcaagttcccaaccaaaaattactagatatgccaagaagcaaagagatgaaacccacagccaagagaaaaataagtctataaaaacagacacataaatgatagaaaagatggtattagtagataaggttattttttctttctttctttcttttttttttttttttttttagacagagtctctctgtcaaccaagctagagggcagtggcattatcccggctcactgctacctctgcctccccggttcaagctattctcctgcctcagcctcccaagtagctgggattacagatgcccactgccacacccagctaatttttgtatttttagtagagacagagtctctccattttggccaaggtagtctcaaactcctgacctctagtgatctgcccacttcagccgcccaaagttctggattacaagcatgagccaccgcacccaaccatagataaggctttaaaacatcttatataaatatgtaaatggatattaaggaaagcattaaaataatgaggggagaaacttaaaattgtgaaaaaaatgtaaaacttctgatgtgaaattgacaatacctaaaatgaaaaatcattgatggtcttgatagcaaatcaaacatcagaaaagaaaagatcagtaaatctgaagaaagggcaatagaaactaaccagcataaagcacatgctttcagtcatatatacaaagctacaagaaatgaacaaagccactgtgacctgtgggaaaatgtcaagtggtctaagatacatataattggcatttaggataggtgagacagaaaaaattctttaaagaggtaatgaccaaaatgttcctaaattttataatatataaacccacaattccaagagattcaacaaaccctaagaaagataaataccaaaaaaaataaacacacatcaaggcacataataatccaattgcttgatgtgagctataagaagaaaatcttaaatgtgaggaaaaaaactcacaagacctacaaagaaatgaaggtaagaatcaatacaaacttcatattgaaataatgaaagccaaaggcaatggaataatatttaaggtgctataagacaataaaaataaaaacaattaagttagaattcatacccagaaaaaattatcttccaacaataaaagcaaaataaatacaatgatagtcagaagctgaaaagattcatcacctgcacccctacactgcaaaaaaaaaaaaaaaaaaattaaaggaaatttttaagctgaagggaaatgatacaaactggaaatatagatttgtacaaaagaataaagtgagctagaggggtaaatgtagaataaattccaaagacattatttttctcattttaaaatttcattaaaatttcttttttaaaccaaaaataaataatacatatgtggaagtttaaaacatacatatacataaaagtttcaacaataatagcacaaaggacagaaaaaaatagaagtatactactgtaagattttaatattataataaatgatataatatcatttaaatgtagactaaggtaaagttaaaggtgcaaattgtaaaccttaaagcagtcattaaagaattcatcaaatctgtaaagctaattaaaacacacacaaacacacacacacacaggcaaagcaaatcagtgtttttcaaagtcaaaatagttaactttgtaggaatagtgactagaagagggcacaaggggaacttcaaggtaatgctccggttatgttatgcttcttatctgcatatttgctatctgggtgtcttcacttagtgataactgagttgtacagttaagatatgcagttttccacatttacataagcatatatgtatgtgtgtatataaatatatgtacacaagggggcttgaacgggttggtggaaaaattgaattaaaagatgaaaatatggagctgactgcaatggctcgttcctataatcctatctacaggtgggataattgcttgagctcaggtgtttgaggctgctgtgagctatgattgcactactacagcctgggtgacacagcaagaccccatctctaataataataataatgataaaaaatacaaacttcatttttcaggataagtttcatcaagttcaaaacacttttgttttcttcattcttgctgtcatcttaagtttaagacacttttgtaagcaatgatatcagccatttagtccatacctaaagagctgaacatcctggaaatataatcatgtcaatgcagtttttttacattattaactgaagaaaaatatgtctccttaacagattgtttaagatgacgaaacaaaaaaagtcaaaaggagacaaaacaagtctgtaaggtggatgcctaatgatttcccattgaaactcacaaaattgcctttgtttgatgagaggaatgagcaagagcattgttatggtggaaggagactctctggtgaatctttcctgggcaattttctgctaaagctttggctaactttctcaaagaactctcataataagcagatgttatcgttctttggccctccagaaagttaacaagcaaaatgctttgaacaacctgaaaaactgttgccatgacctgtgttcttgactggtctgcttttgcttggactggaccacttccatttcttggtagccattgctttgattgtgctttgtcttagggatcatactggtaaagccatgtttcatcttctgttacagttctttgaaaacacccttcagagtcttgatcctaattgtctaaaatttccattaaagtctctgctcttgtctgcagcagatcagggtgcaatggttttggcacccatcgagtggaagttttgttaaactttaatttttcagccagaattgtgtaagctgaaccagttgagatgtgtatggtgttggctactgtttgcacatttaattcttcagttagggcatgaacgagataaattttttccttgcaagttgatgtggatagtctgctgctatgggctttgtctgcaacattgtctcttcccttcttaaaatgaattatccatttgtaaattgctgatttctttgggacattgtctccataaactttttgttaagtatcaacaatttcaccattcttacacccaaacctcaccctatatttgatatttgctcttgcttcaattttagcagaattcatgttgctctgataggggctctttcaaaaggtgtcttatccttcttagcatctcaaactagatcctgtctagacatgttaatgagctagtatgagtttattttggtgcaaaaaaaaaatcaaaatccatgcatcaagttttttataatatgcattttccataagtgttttaaagattcctcatgtgtgtgtgcatttgtgtgtgcatacatacatacttatatgtacataaggcaaagggagacaaataacagatcatctcagaaaatatcaggactatcacattgcccacctaactcacagatgcacaactcatgtcccagtctttctctataaatagcaccccttggagttctacctgaacaaaattgcatggctttatctgattactgtggaaactactactctattagaattacttttcaaaagcttttagtggtccgttatacatcaaagaacaagccaaggaatgttaatccaaactttatccattttgtttttgagaaaatagtcaggcacccacctccttgcctgactaatttttgtatttttaatagagatggggtttcacttgaactcctaacctcaggtaatccacctacctcagcttctcaaagtgctgggattacaggggtgagccactgtgcccggccaatcaaatttatttttaaggagcctcagggagctgagtttttctataaaacctcttcaagaaaacactcacagctgggcaaggtggctcacacctgtggtcccagcacttagggaggccaaggagggcagatcacgaggtcaggagtttgagaccagcctgaccaacatggtgaaaccctgtctctactaaaaatacaaaaattagccaggcatggtggcacacacctgtgatcccagctacttgggaggctgaggcagaagaatcgcttgaactcaggaggcggaggttgcagtgagccgagattacgccactgcactccggcctgggtgacagagtaagactccatctcaaaaaaaaaaaaaaaaaaagaaaaaaaaaaagaaaacactgatgaaataatgttttctattaaatgtatgatttaatactttatgttttgtaaatttgtttgcttttcccttcttttcatgaccatttacatattttatggtataggatttcaggtatagaattttagtttataatttataacactattctaaaccaattcagctcacaattgcgtacattgctacaattgccccaaaactaatgaggtcgtaagtaaaaccttacctatgaaacagataatatgtgtctgtcaagatcctgttcaagcatcacctcctctctgaagccttgctggattccaatgaggcagaattaattaccgtttcttgaagcatcaacatattgtgcatcttctattaaagcacatgtcctagtgaaaagagctgatttgtttatttctctgcttccctgacgagactgttttagccatctttgtatgttcagcacccagtatagggtctaatccatgacaagtgctcaaaaattgtttcaaagttggggagagaggatgggggcccaggatgggggaggtaaatgggatggaaaaaaaaagaaaggatttgcttaacactagtaaatgaaagggaagatattcttggttggataaaacagttgtttgtccagcaagcttaaatttgcatccattgtcacaaaataattagactctctctaggtcgtttcacagcactgactgtaaatactttgaaagtattaatccagtgttagactggtgcttcgtgtcctgctatgccatatgaattgtttcccttatgatctgaggactgcaaaatattttacaaatattatcttgccaaatgagtatgtgtaaaaattgtcctcagggcttccagtgatgaaagagtttgcacaccaacaaaataaacatgcttccgcaacccccaggcaacactattcactcccttctctgattcccagagcacattattcatttctctaatacagcattcagtgcagtctgtcagagtctgttaggctttccctgcccagttgtattgtaagcttcttgaggacagagactgtgtttttatcttgttatccccagttcctaacacagaaactggcacgtggtaggtgttccatactcatttcttgagtgattaaatgaataagaaaacatcttgtagtacttttatttgaataggtcctaaaagtcctgtcaatctagctgtctggagtccaactttaaaagcatctccaaaataaggagccaataaaagtctttgttaagagttgactcctgatcctgcagtggcaacatgacaaccagaaaggggccttaaatcattctcagtatcctaggaacaatctgatcaccctgtgtgaggagggcaaccctttaatctgtagcaatatttagtagtaattgtatttttcatgtgaaacttgataagctcagagatatttggagaaccagtaaaaaagcaaaaagaagaacaaacaaaatgatagaaatggaaagacaaattgttttctatttaaatacaacatatgccaggtactatgtgaggtgctcaggattcagtgttgaaataagatgtgctccaaggcctggttcacatatttctggggcctgtggaatcttaaagtgcctcctgctaccatctcaaaatgttccccagaggaaaaaaaaaaaatatatatatatatatatatatgatcattgagtctacagcaatttggtggtgttccattttggtgttcatttggctttaatataataaaatgtactcttcatttaccaatagaacaaacaagtcactaaaacaaaatgtcatagttatgatttcactcccaaactgctcttcagtgtcaaagtcagactcagcagcctcagagacaaaactgctccaccctacccattcaatgacaaaacacactgaagagccttggcagccagcagagcaagtcctgcattggggttttggatgatgagatcaagacgtgatcacagcagagttatattagtgcaattactaagcaattaatagacctatagactattctcatgaacccataatgagaccagggtatcaagacaaggagggtcatacacagggccgtgccagtggaaggagggttcaggaaactctaaaacaattctgaaaaaaattttaatatgccaattaaggaggacatttaccaatgtaattatagtatctagattatttttgaaaccctgtatattaaaacttatttgaatgtgactttttgtgagattttcaaaggaaattttctagtagttcaaacgctccacaatgttttattttaaattttctagaatttgtattgggaataaatataaaatgggcccaaagtacttccttttcagaaacagaacttcacattaaaacttcaattaattatcatttgggatattcattcttgcagcaaatatggatgcgttgcaatgatgaatcttttcagtgtgggacactgatgactctgacagggtctatcccttcagaaatctccagttgagtaaggtaataagatgtgtgctcaaacaagtaaaataagaggtaaaatatttttacaaattctaagagagatccagagaaaatgccatgggacatcaggggataaaaacaatgtatccaggtaaaggccaaaaaatgaatcagaattactgggggcggggggtggggtcaggggcggtgggaataaacagtctgtttagtgactgtgacataggaacagtttattagtaagaataatgccagctgagcatggtggctcacacctgtaatcccagcactttgggaggccaaggcaggtggatcacttgaggtcaggagttcgcgactggcctggccaacatggtgaaactcctctctactaaaaatacaaagaatatccgggcatcttgatgtgttcctgtaatccccgctactcaggaggctgaggcaggagaaccacttgaacccaggaagcagtggttgcagtgagccaagattgcaccattgcactcaagtctgggtgacacagcaagactctgtctcaaaaaaacacaaaaaaacaaacaaaaaaagaataatgcctatattccagatgtgttatatgcataaaagagtgcatatgtaaagtgggtgcggtggctcacgcctgtaatccccacactttgggaggctgtggcgggtggatcacctgaggtcaggagttcaagacctgcctggccaacatgatgaaaccctatctctactaaaaatacaaaaaattagctgggcatggtgatgggcgcctataatcccagctactcaggaggctgagacaggagaatcgcttgaacccgggaggtggaggttgcagtgagctgagattgtgccactgcactccagcctgggcaacaagagtcaaattctaaaaaaataaaaaataaaaaataaaataaaagagtacatatgtaaaaggtttcaaatgtcatcaagcatgtaactgatgtctaataaatgagctaaaatactgtgtaacttttgaagattcattgccagtttttgtttgtacccttactaaaaatctttagaaatattagtttacttttatccttaaaaatcagtgcttcctgatgataatggtttgttaataataagcttagagtgccccggtctttacaatttttattgcatttcacattgttttagcgataagtggagatctagagttgaaaatgtaaatgctccagggaccaggcaggtcatggaagcatgtgaaacaatctgtaataaagcaataataagcagtagagatctgggcaagttggaaagcaactgtgtcttctgaaagcattccatttcaagttccaaaggtttaaaattctgtatttcaaagattcagataaacctctgtcaaaatcccagctgttatttttgcagaaattgaaaagttaatcttaaatttcacatggaaatgcaaaggatccagaataaccaaaacaaactggaaatagaaactaagttggagattttacacttcttgatttccaaacttactacaaagctacaacaatcaaggcagtatggtaccaacttaaagagatcatatatagatcaatagaatagaactgagagtccagaagtaagccctcatatttatggcatattgctttttaacaaaggtgttaagacaattcaatgtggaaaggatagttttttgaacaaatgatgcttggacaattggatatctacattgcaagaaatacatttgtccctttacctcataccatgcacaaaaattaactcaaaatagctcctagacctaaatatatgagctaaaactataaacctacttaaagaaaatataggggcacatttatgtaatcctgtgtaacaaatatttcttagatatggtatctaaaatttaatgaagaaaagataaaaataatacattggacttcattaaaattagaaactttgcccttaataaaacactaccaagacaataaaaaaagacaagtcatggattacaaaaatatttctaaattgtatatccaataaggaacttgtatccagaataaaataattcttttaactcaataagaaaacaaaccaattttaaaatgtgaagtgtttcataaacatttcaccaaagaagctatataaatggcaaataagcccgtgaaaagatgcccaataacattgggcattagggaaagaaaaattaaaatcatagtaagataacgttttgcacccactagaatggttgtagtcataaatagccaaaaacaagtactgatatggatgtagggaaattggacattgcaatgccaaatgaagcagtcacattggaaaacagtttcagtttttttaagtattaaacatagatttaccatatgaccaagcaattccactcctcagcatgcaagataaatgaaagcgtatatccacccaaagacttgtacatgaacagcattactcataatagtcaacagtagaaataatccaactaagcaatgcataaacaaggtgtggcatatccatacaatggaacactacttggcaatgtaaaggaataaagtattgaaatgttctacaacatgaataaacctcaaaataaacctatggtaagtgaaagaagccagaaaaaaaagtcacatattggataattacatttgtagaaaatgacaagaaatgagagttgaattttttttggaggccacactttagatacattacagcatttacctcccttccactgccatccattctcttacttatcaactcaatacctttcttatcagcccccaaatccctatctcctctatttcagttcatctctcatagcaatgattttgccaaagaattcctctattgtgcaatctcttcttttataattgtgctttcatgatatattagttaatagctggaggcttggagcctgagatacatgaacttgtatcctagatactaaccagatgtttcttagaaaaattatttaacctctcagaacttaacctataaaatagagttaatttcatttccttcgtagagcagtgtaaaaattaaacaagcaattacgttgaatgcttattgcatgccctggtccaataaaatagagcttttagtattattagaataaatgacttgtccaggttcactgataatagtgaggggattagatccctttgtatcatattgtactgttccatgctgcccgttttctttacctgacacaacttgcattgtaggctaaatgaaaggagtgtttagcaagaaaagcctaaacataagcataagcgaagactaggctctaatattgtcatcataatttgctagctctgtcaccctgttcaacattctgagtcttcagatttgtctatcaaattactgactgtgattgtatgtaatagaaatattgtagatgatttataaatgttagttgcttatgcattgcagctcaaattaccctatttatctgcaggagcctatttttccctttcttatatacagtgccctcatgctctctgccagccaccctccaatccaaacctacttaaaaaaagaaaagctgacatcaacaacatggtggaataggcagctcttgactctctttccacccatggatgcatcaaataaacatttattcatggatcaattccctctgaggggaagccagagaccagttgagagactcctaccctctggagaagtcagaaacattcacattaaacaggcagaaaatgctgaggcacattcaggcatggacctccctctaggcaccatgccataagattgggaaagaaatccccaacacacaacatctccctgtggagagaaggagttggacctcacatagactgccctaactctaaagttcccatgatttggcccttaattcaccaactctgggaatgcagggaagggattactcacaagtgagtttttctagtggtgttttattaagtacaaaagttcctgggccaggtgtggtggctcacacctataatcccatcactttgggaggccgaggtgggtgaatcacctgaagtcaggagttcgagaccagcctggccaacatggcaaaacccagtctctattaaaaataatttttaaaaaattacccaggcgtgggcacctgtaatcccagctacttgggagactgaagcaggagaattgcttgaacccgggaggcagaggttgcagtgagccgagatcgtgccactgcactccagcctgggcaacagagtgagactctgtctcaaaaaaaaaaaaaaaaagttcctaattttgatgaagtccgatttattatttttatcatttattcattgaacttttgataccatatctaagaaatatttgttacacaggattacataaatgtgccccacattttttctttatacaagctgcaagtacttccaggggctttttcttccaggaacagtgcagagagagagctataaaaacttcaaccccctatttctccctggaaaggacatagtgttccagtggccacttggtgacctgggttctaactaacttgtgtaggcgagtaggaggagcagacaagtattaacttgctggcaagctgagaagatgggcacttcttgagccttctctgactcctcccagtgacgattccaggtctcttaatccttggaagaagttttttcacagatagagcaccctaacttttatagcttctatcaagggacagcatcctaaacctcctagccctggaagcagaggacaattagaaatgtgactctatttagacgacagaaaaaaactgaccattttatgtggatgcataagcactttcagaggcttcattccccaggagtagtgcagaaaaggggctttaaaaatgtaccttccgggaggagccaagatggccgaacaggaacagctccggtctacagctcccagtgtgagcgaggcagaagacaggtgatttctgcatttccatctgaggtaccaggttcatctcactagggagtgccagagagtgggctcaggtcagtgggtgcgcgcactgtgcgcgagccgaagcagggcgaggcattgcctcacttgggaagcgcaaggggtcagggagttccctttccaagtcaaagaaaggggtgacagacagcacctggaaaatcgggtcactcccacccgaatactgcgcttctccaacgggcttaaaaaacggcgcaccacgagattatctccggcacctggcttggagggtcctacacccacggagtctcgctgattgctagcagggcagtctgagatcaaactgcaaggaggcagcgaggctgggggaggggcgcccgccattgcccaggattgcttaggtaaacaaagcagcctggaagctcgaactgggtggagcccaccacagctcaaggaggcctgcctgcctctgtaggctccacctctgggggcagggcacagacaaacaaaaagacagcagtaacttctgcagacttaaatgtccctgtctgacagctttgaagagagcagtggttctcccagcacgcagctggagatctgagaactggcagactgcctcctcaagtgggtccctgacccctgaccaccgagcagcctaactgggaggcacccccagcaggggcacactgacacctcacacggcagggtattccaactgaaggtcctgtctgttagaaggaaaactaacaaacagaaaggacatccacaccaaaaacccatctgtacatcaccatcatcagagatcaaaagtagataaaaccacaaagatggggaaaaaacagaacagaaaaactggaaactgtaaaacgcagagcgcctctcctcctccaaaggaacgcagctcctcaccagcgatggaacaaagctggatggagaatgactttgatgagctgagagaagaaggcttcagatgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatacagaagcctcaggagccgatgcgatcaactggaagaaagggtatcagcaatggaagatgaaatgaatgaaatgaagcgagaagggaagtttagagaaaaaagaataaaaagaaatgagcaaagcctccaagatatatgggactatgtgaaaagaccaaatctacgtctgattggtgtacctgaaagtgatggggagaatggaaccaagttggaaaacacactgcaggatattatccaggagaacttccccaatctagcaaggcaggccaacgttcagattcaggaaatacagagaacgccacaaagatactcctcgagaagagcaactccaagacacacaattgtcagattcaccaaagttgaaatgaaggaataaatgttaagggcagccagagagaaaggtcgggttaccctcaaagggaatcccatcagactaacagcggatctctcggcacaaaccctacaagccagaagagagtgggggccaatattcaacattcttaaagaaaagaattttcaacccagaatttcatatccagccaaactaagcttcgtaagcgaaggagaaataaaatactttacagacaagcaaatgctgagagattttgtcaccaccatccctgccctaaaagagctcctgaaggaagcgctaaatatggaaaggaacaaccggtaccagccgctgcaaaatcatgccaaaatgtaaagaccatcgagactaggaagaaactgcatcaactaacacgcaaaataacaagctaacatcataatgacaggattaaattcacacataacaatattaactttaaatgtaaatggactgaatgctccaattaaaagacacagactggcaaattggataaagagtcaagacccatcagtgtgctgtattcaggaaacccattcacgtgcagagacacacataggctcaaaataaaaagatggaggaacatctaccaagcaaatggaaagcaaaaaaaggcaggggttgcaatcctagtctcggataaaacagactttaaaccaacaaagatcaaaagagacaaagaaggccattacataatgataaagggatcaattcaacaagaagagctaactatcctaaatatatatgcacccaatacaggaggacccagattcataaagcaagtcctgagtgacctacaaagagacttagactcccacacattaataatgggagactttaataccccactgtcaacattagacagatcaacgagacagaaagtcaacaaggatacccaggaattgaactcagctctgcaccaagcagacctaatagacatctacagaactctccaccccaaatcaacagaatatacattttcttcagcaccacaccacacttattccaaaactgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagggaaagcaggaaagatccaaaattgacaccctaacatcacaattaaaagaactagaaaagcaagagcaaacacattcaaaagctagcagaaggcaagaaataactaagatcagagcagaactgaaagaaatagagacacaaaaaacccttcaaaaaattaatgaatccaggagctggttttttgaaaggatcaacaaaattgatagactgctagcaagactaataaagaaaaaaagagagaagaatcaaatagacgcaataaaaaatgataaaggggatatcaccactgatcccacagaaatacaaactcccatcagagaatactacaaacacctctattcaaataaactagaaaatttagaagaaatggataaattcctcaacacatataccctcccaagactaaaccaggaagaagttgactctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcatttcatgaggccagcatcattctgataccaaaacctggcagagacacaaccaaaaaagagaattttagaccaatatccttgatgaacattgatgcaaaaatcctcaataaaatactggcaaaacgaatccagcagcacatccaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaagcctttgacaaaattcaacaaccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatttccttaagccgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatggataggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctgggggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaaggaatggggaaaggattccctatttaataaatggtgctgggaaaactggctagccatatgtagaaagctgaaactggatcccttccttacaccttatacaaaaatcaattcaagatagattaaagacttaaacgttagacctaaaaccacaaaaaccctagaagaaaacctaggcattaccattcagggcataggcatgggcaaggacttcacgtctaaaacaccaaaagcaatggcaacaaaagacaaaattgacaaatgggatctaattaaactaaacagcttctgcacagcaaaagaaactaccatcagagtgaacaggcaacctacaaaatgggagaaaatttttgcaacctactcatctgacaaagggctaatatccagagtccacaatgaactcaaataaatttacaagaaaaaaacaaacaaccccatcaaaaagtgggcgaaggacatgaacagacacttctcaaaagaagacatttatgcagccaaaaaacacatgaaaaaatgctcatcatcaccggccatcagagaaatgcaaatcaaaaccacaatgagataccatctcacaccagttagaatggcaatcattaaaaagtcaggaaacaacaggtgctggagaggatgtggagaaataggaacgtttttacactgttggtgggactgtaaactagttcaaccattgtggaagtcaatgtggcgattcctaagggatctagaactagaaataccatttgacccagtcatcccattactgggtatatacccaaaggactataaatcatgctgctataaagacacatgcacacgtatgtttattgcggcattattcacaatagcaaagacttggaaccaacccaaatgtccaacaattatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgctgtgggggtggggggagggtggagggatagcattgggagatatacctaatggtagatgacgagttagtgggtgcagcacaccagcatgtcacatgtatacatatgtaacctgcacaatgtgcacatgtaccctaaaacttaaaagtataataataataattaaaaaaaagaattatcaactcaaaaaaaaatgtaccttcctgtttctccttagaagggtttataccacatatcaagtgcctcaattttacagctacctcacaaaagattccatgttaaacttcttggctttgggagcagaagggactagacctatgtgagtctctctagactacagaaaaaaagaggtaatattaaatgtggtgcaaacatttccagaggctacaccccattggagcaatgcagtaaaggggcacagacattcagctcccattttctctttggaaagggctttccagtgactacttgctggtctggcttctaacaaacttgcatcagtagctaaaagagcaaacaaacaatagccctccagcagccaaagccagagcttgcctcttcatgagcctttcctccagctcagcccagtgataaatccaggtatgcccattcttcctggaaggaatttggttcagagccacaacttccataagccccaagccaaaggactgtctacttaacaattcagccctgggagttgatgggttttgcctttctgggtggccttaaaccacaggaaacaaacaggtggacatacaataggtccacttctagcaactatcttcccaagaacagagggtgcaacataaacatgaatacaggaatttgccacagatcctcactacagcttaatgcagggtgaaagatatatgcctctgctcagctttaccaggaagatagaaggaagtagaataaacatccaacatcttaaattatcagctacatctagaaaatctgactcctaccttaccagtcctgggctactgacaggctattgtacattctaagctccagtgagccaccaaaaacagaaagaaaatttccaaattcaaagattcgagatgtaccttaagatctcagaacagatgaattggtgagattcttgtcctacaggaggccagtgtgacaagactggtagaggttatggtcttatctaatgtgtagaaaccaatacagagagtcaaagaaaatgaagaaaccattttaaaatattccaaatttaaaaagaatttctacaaaccaacttgagtaaaacgaagatatgtgatttactttatttatgttcagtgaggtcagaagaggaatgcaagaacaaactgagaatttctttttttttttttttttgagacagggtcttgctgtgttgcccaggctggagtgcggtggcatgatcttggctaactgcaacctctgcctcctgggttcaagtgattctcctgcctcaacctcccaagtagctgggattacaggcacatgccactatactcagctgatttttgtatttttagtaaagacagggtttcaccatgttggccaggctggtctcaaacttctcacctcaggtgatccacctgactcggccttccaaagtgctgggattacaggtgtgagcaaccacacctggccacaaactgagaatttcaacaaagaatagagaggctcatcagcagactaaatcaagcagaagaaaggatcagtgaccttgaagataggtgattggaaatcatataatctaaggagcgaaaagaaacaaaagaataaatgaggaaaatttaagaaatttatggaacaatatcaagcataccaacatttgcgttaccagaataccaaaggagaagaaagagaaagggacagaaaatatgttaaaagaattaatgtcagcaagtttcacaagtgtgaaggaggaaatagaaatccagatccaggaagcttaaaggacaccagataagatgaatttaaaaagatccatatcaaaacacattacaatcaaactgtcaaaaattaaaggctaagagagagttttcaaagtggcagggtaaaagtgaattgttatatacaagagaaccttcataatattattagaggattttttagaaaaaaacttgcagtccagaagggagtgggatgatatgtcaaaaacctgaaagaaaagaacaaatgttaaccaagaatactatacccagcatccctctttcaaacatgttggatgataaaaactttctgaaacaacaaaagctgagtttaccactactcgacctgccttacaggaaatgctaaagggagttagtcaagctaaagaaagagaattctaattagtaacatgaaaatatatgaaagtataaaatcactgataaaaataagtatactgtcaaatccaagatactcttatattgtaatggcagtgggtaaatcagttatgtctctagtataaaggttaaaaggcaaaactatcaaaatacaactaaaactacaatgactcgttatggataaaaattattttaaaatgtaaactgtaacatcaaaaacacaaaggactgtctacttaacaactcagccctgggagttgatggatttttgccttcctgagtggccttaaacctcagaaaacaaacaggtggacctacaataggtccacttccagcagctatcttcccaaaaacagagagtgcaacaaaaacaggaatacaggaatttgccacagatactcactgcagcttaatgtgggaggaggaatagtaaaagcaaaaagtttgtgtttgcaatcaaggctaagttgttattacattaaaatagcctattgtaagtataagatgttttttgtaagcatcagggtaaccataaagaaaaatcctataatagaaatacagaagacaaaaagagaagatacaaaacataccactacagaaagccatcaaacacaaaataaagtactagaggaagaaagaagcacagggtgtacaaaacaatcagaaaacaactaacaaaatggtacaaataagttcttacatatccataactactttgaatgtaaatatattaattctccaatcaaaaggcatagagtggctaaatggatatttttaagaccataacaagacccaatatgtgctgcctacaagagactcacttcacattaaatgacactcagaccaaaagtgaagagatagaaaaaataactccatgcagatgtaaacaaatagagacaggggtagctatactcttttaaggcaaagtagattttaggtcaaaaattgtcaaaagaaacaagatcattatatagtcaataaagaggccaattcatcaagatgatatgacaactgtaaatatgtatatgcacccaatatcagagcatctacatatgtaaagcaaacattaagaggtctgaagggagacaacactgcaacacaataatagtagaagatgcaatatcccactttcaacattgggcagatcacacagaaaattgatttttttaaatgattggacttgaactacactttagaccaaatagacctaacagacatgtacagaacatttctctctacagcaacagaatatatatgtattacatttatattctgtatatccattatatctatatatacattataatgtatatataaatgtataaatgtacatttgttgctgttgagtggaatatacattgttttcaagtgcatacaaaatattctccaacatagatactatgctagaccacaaaacaagtcttaacaaattttaaaatatcaaaatcttatcaagcatcttttctaatcacagaagtgtgaaactagaaataaataacaggagaaaatcatagaaaataaaaaagttgtagaaattaaacaatataatcctgaacaactattgagtcaaagaagaaatttttttaaaaaaaattaaaatatcaagacaaaaaatggaaacacgagttatgaaaaccttggagataaataaagcacttagaggagggaagtttatagcaataaatgcctacatcaacaaagaagaaagatctcaaataaacaacctaacattacagttcaagaaattagaagaaccaactaagcccaaagttagcacaagaaaggaaataacaaggaccacagcagaaataaatgaaatagagactagaaaaacaatagaaaagataaactaacgtaagcgttggatttttggaaaactaaacaaaactaacgaaatcttagttagaccaagaacaaagagcgaagaatcaaattaagagagtcagaaatgaaagaggaaacattacaaatggtaacacaaaaatacaaatgatcacaaaagactgctaagaataactatacaccaacaaattgcacaacctagagaaatgaataaatttctaaaatatataacttaccaacactaaattataaagaaatttgaaatctaaaccgatcaagaacaagtaaggaaattgaattagtaactaagtctctcatacaacaggctcaattccagcagctatctggaaaagataaagtgaaattatgtgtttgctgacaacatgatcttgtacacagaaaatcctgaagaccccaccaaaaaattgttgaaactgatgaacaaattgaataaagttgcagggtgcagttacagactgcaaaatcaaaaatcagtagcattactatacactaacaatgaactgtctgaaaataaattcagaaaatttctctcataatagtatcaaaaaataaaatgtttgagtaaatttaaccaaggcatcaaaatatctgtatactgaaaactgtaaaacattgacaaaagaaactaaagattacacaaataaatgtaaagatatttcatgttgatggactgaagaattaattctgttaaaataaccatgctacacaacgtgatctaccaattcaatgcaatccctatcaaaattcaaatgtcattctttgcagaaatagaaaaaaatttctaaaatttatatggaaccacaaaaggacctaagaagctaagaaggtcttgaccaaatagagcaaagcttgaagcaacagactactggataaaaatactttacaaagttatagaaatcagaacagcatgatactactattaaaaacagacacatcaaccaatggagtagtacggagtgttcagaaataaacccacacatctacagccaattgattttcaacaagggtgcctagaatacacaatgggtaaagaatagtctcttcaataaatgttggtgggaaaactgaatattttcatacagagatttaaaatagacccttgtctcactccttatacaattatcagctcagaatggattaaacacttgaacataaggtctgcaatcagaaaaattataggagaaagctatatgacattgatctgggcagtgatttcttggatatgacctcaaaagcgtgggcaacaaaagcaagaatagacaaacgggatttcatcaaaataaaatgcttctgcacagtaaacaattaatagagtgaagagacaactcaccaattgggagaaaatatttgcaaatcatacattcgataagaggctaatatcttaaatatacaaagaactcaaactacaaaataacaagaaaacaaacaaccctattcaaaagggcgaaggacttgaatagatctttctaaaagaagacatataaatgaccaacagacaaacaaaaaaattgctaaacatcttcaatcatcagagaaatgcaaattaaaaccacaatgagagattgaccatcattaaaaagacgaaagatgacaagtcttggcaaagatgtgaagaaaagggaactcttatacactgctgatagtattgtaaattagtacagccattttggaaaacaacataaagggtctgcaaaaaattaaaaataaaattccaacatgatccaaccatcccactactgagtatatacccaaaggaattgaaataagtatgtagaagagttacctactctcctatgtttaatgtagcattattcacaatggcccagctatggaaataacctaaatgtccatcaatggatgaatggatttttttaagtgtggtatacgtacacaatgtgatactattcagccttttaaaaacccaggaaattctttcatttttgacaatatggataagcctagaacacattatgttacatgaaataagccaggtacaaagagacaaatactgtatgatctcacgtacatgtggtatctaaaaatgttgaacttacagaggtagagtgtagaatgatggtggttactagagattgggattgagggaggagtggatgggaaaggggagacattgatcaacatcagtgagataagaggaataagttctgatattctattgcacagcacagtgactatagttaacaataacgtattgtatatttcaaaacagcaaaaagaaaagattttaaatgctctcaccacaaagaaattataaatatttgaggtgatggatatgctaattagcctaattttatcattccacagtgtataaatgtattgaaacatcccattgtagcccataattatatacaattcttatttgtcaattaaaaatacaataaaactttaagaaaaaaatagtgattgaagagtaatttagagtaaagatgacatttacttggttcatggtccattgatcccatctccacccatcacatcatcctttccttgtgagcaagaatatgacttcaaagccttccccatccagtgttccagctgtcattatcaattgaccagagccgagatacaagctgaaacctatttggctatctcagggttggagttgcacccactccaagtgaaatatatttttaagacatttcacaaaccatgtgtaaagggaggaggggttaccaccagtggtagggagggatagtgtaaaagttactaagaggatttttgaaacagtgaacttaccctagcaggaaattgcgaaaggttcactacggatagtcagagggaattcaggttttcaataatacctgaaagtccaataaaaacaaagcccacaatatctcagaacatctcaggcccccaagctccctggcatgtaccctcgctaatgtcttttgtgtttttttcctaaaatgtaccattcttaaaaaatgagagccaagctccaggagatgaaattctacatctcaaatacatcgagagtctcagtgcctatagccccagcaagctgcagtgatcatgagtaacattacaaacttcatggaagactggtagcctcaggaagaagctgtcaacccgaattaagacgtcaacgtatcagatgaggaaggtactgccatgaagcctattgttgcatgcgtgtcaggtgaaggccatactaattactgcgtgatccaaatatgtctgttccctactcctcccaaactaaggtcactgagttattatggcctggtggtttgcactattttggattctgccaagtggcaggtggcctgacaaacatgcgactcagcatgttttgttgggtccccacagctgtgctgccaatcagttcaggatggctgcaagttaatgctaattagcttctgttgatctgcatattccaacagcctcccaggattcccattttgatatgcaagattgccggttgggtatgtgattgaattaagaagcaagaaagattttagtttccatgcggggatatgcggatctgaatccccagcagaagctgttacccttttgatttatggttggcagctctggccatcagcatgggagcatgggctctaggctagagggtgctgcccccctgcttatggaaacaaccgacgccttaacctcctagcactattaggagtaaacattctttccatctgctctgtgaactggcactggcagtttatttgagcaaggaatctatagttttccgtttgattcaaatctatttagttcaaataatctaaacaaaaatgtaacagtaaagaagaattatttcctgtggtgtacaaaaagtactaatttcaaactgtcactttcaaactcactgggtatctttgaataaactgcttcaccttcatggccctcagtttctcgaatgcaatgttaggaggtaatgctagagtctattaaatgagagaaagtatatgacaaggataacaaaatgtctgacacatatgagctcttggatattttaatatatttttataccataaaaaaataaaaagctatacagtgccttctctgtgccagcactttgcacatggttggagattcaaatatgaacaaaaaattattcacttccctccaggagtacatagtaaacagataattacaatttgataaataaggttcattccaacaatgatattctataattctattccttctttctttctgctatgacaacatgggaacaccacgagcttctggcttcataatagctttgttttcttgagtatgttgcttaacttatctgagcccgtgtttctccttctgtaaaaacaatataccccacataacattgttgagtaagtttaatgaaataatgcttgttaaagctactgacacatagtagacattcagtaaacagtatttccctgatgttttcttttttagtggatattattagaatcacatgagtccagcaaattctggggtgaaggacagaggtagaagaaaaagaggtggaaggatttcagccttgctaagaaaggaactcagcaggaaacactgcactatgggggctaatgtatttagattttgcacctgtatttcatcagggcaatgaaaatatgatctcactgggtaaacattacaaaacaattttcaaaagttttacttggctacagccttagaaagttccgcttccctgaagtgattaaataatatttcttggaaaacatttgctaaatataattttaaggagaagtttttttctcattttcatattgttgaatttgagggtcccaattgggattttgtaggaaaagttactaaaactgttgctatatttatattttatatttattacatattgtatattttcatatttgtgtgtatgtataaatatgtatgtctccattttctatgtatatgcatataacacatatgagcatatgtgtctatatatagtgtatgcatttaaatctgcatctatgtgtatagaaatttatgttcattatgatttgagaatggagtgtatgcatatacatatgcatgtgttttataatatgacacccatatttatcatttattgtagtggttaagagcatagatgtatagactctgaaatagacctgaatttgaatttcagctctatcagttactgctatgtgagtatagccaagttatttaatctctgcatctcagtgaatttctctgtaaaatggagataataattgtacctaccacaaagattgttgtgaggattaaatagattaacatatatgaaaatgtttaaacaaaccttggccaataagaaactctattttatattattttaataattgctattgttattatgactatttgtgttattgttattttttcatgcatttatttgttctgaatcactttgactttaagggttttttgcttaaaacctcaatgaaaggcaatttttaaaaagtaatatcagagcttgtagagtttctgttttgcaagtggtagatattttgattaaattttgaagcacattatatctttgttttgaaaagaatcatctggatatatgtattcagctatgcaaatgttaatgtaactactctccatcccaccccacctcatcgccatccaccttgttggataacctgaatgcatatgttttagactaaatgaagaaatgtgctatttggcaatgcaaattagatgtatgctttagcaaagctatttccttgcatactttgctgctactttgagagaaatatttctttattaaggaatttaggctgcagattattgcttgttttgaccaagatgcatgatcaaaagagattagtaacagagacttcatgactgcaggaaaagaaatgcagccccaccgtttaactcaagttgggggacaaattggacaaaagggttgagtgagcttggcacaagtcaaatgggactggatttgatgcttcgctccttcctttcctagtgatgtgaccttggtcaagtagtgaattcagagataaatgcctgagtctttcaaacagtattgatgttggactgttaccctgttgcatcatggtcttgtggtggccacagggccacacagtacctctgctgatgaaaggtggagttttctataaagaatgcggacatttacacaatcatcctgggaaaaatttaatacttggtttgaaatgagaacagggtagaaaattacatattctatggctcttgatttgtttctttaagaaatccatttaactgtgaaactaatatttactagattcttattctggattggacactaattggagtggtaggaacaggatgtacaagacatggcctctgtccttaaaatgctgatacttaaatgagggatataaacgtgtaaacaaataaaaacaatcagtttgatggatgctatggcagagtgcaagaaagaggatgaacacagagaaggaagaaatcataaattctttccaggaataagggaaatcatctaaaataagataaagcttgagctgtctcttaaaaaaaaaaggcaattatagcaaatggaaagagggggaagggtgtttcaagtaagaggaacattcatgaggcaaaggaatatagcaaatttgccactagtttagtgtgcctggatcttaagacataaagagaggaataacaagagctaagactatggaagtagctacccagaccatgatggcctatgtcatgctaacctcttggatttctttttcttagtgtcaatgtgacaccatcaaaaagttctaagcaggtgaaggacttatttatattttcattttagatagtgcattcttgtagacatatgacgcaaaaatgagaagagggaaataacacaggcagggaattatttaagagggcaatatagtaatagggatatggaataataaaggttagaattaaggaagtggtaatgggaataaatacaattgagtatattttagaaatatttagggaataaccatcccctgaacttggaaattggattttaaaaggactgggtcaaggatagtcccagatttcttgtttggaggttacaaataagtaaatattggaatacgggttggagagcaagttgaggaaggataggatagatgagtctagttttgaaaatgataagacttaaatgctttggaggcattcaaatagatacaatacaaattaggataaatcgatttggagccaaatggagaggtaggggctagaggtattgacaggtattcagaaagaattagaaatggtaagtatagttatgagagtagatgagataatccacaaaaaactttcaagtgaaatgagaatatggacaaaggaggaaccaaaggtaatggcaatatgtacaaagaatgatgtctgtcatctactatttaccatttaagtagcattgatctttcaagataccaaatgaatccctcgatttactgaaagaccctaaattagctgtatgatatatggtgctcttgcagaagctgtttactttctctgccaatgtagacctatctgaatctagaggaaatagcaatcttgagccagtagagaaaaaataaattaatcctaattttcaatagaagaattaaaaatttggcaactattgctttgaatggtattctagtctgttctctaaaagacagtgggacacttcactttccttttaaagtaaagtaacaacccaaaaccaggattctattatatttaaaaaattgtccagactacaataaaatgagacattaaaaggccctatttatacagtagtaatgagtaatacaatcatctcttcgttgttggtggttggggcattttttaaggccatgaataaagggtctccaagtgatgtgggcactgtggtttttctcagacagttcaataaatataagataggacccagggataatttaacgagtaagcttagtagagaattttgagtgaggaaaaaccttaggatgtttcttatggatcaaagacaagttttaatgaattgggtggagctgatagagctctgaagtttattctcctttgtacaaaggaaatgatctcacagtaataatacaaatggtattcatgaaatatttttctttttacaaaagttaattatgaatgaacttcatagctcgttagattcagaaagcataatacattttagtaattgacttattctctaggaagggactttatgaatatttggggaaagatttggttgaggataaattagatgtaatggattctttttttaaaaaagtcataacaagcataatatatttctttactttcaagaatttgaggtctgttctctactctggtgccagttgaatatcaatttggttgcagtcttctgcctgtcatgccgaaatctcatcatttcctaaacttgtctaagtcacatgctgttcaaactaccttggaagcctccctcttttctttcttggcaaattgctcatccttaaagaaccatcacaattttatctccagtgaagtcttctccagttcacactactgttccaacaacactttgacatcatatccctatatgaatgttatcaattttcattacagttagcagcctacacatatatttccacagctggacagtgcctagctccatgcctggcacacagcacacattcaggaacattttttgttatgactaccgattattacctattcaatcctcaatcattatctctcttatctaaagatatgtacatatttatatctagctatacgtctatctgtaatttacacagcgagcttacatatgtgatctccttttgaacttcaagattaccacacaggattgtaagagtagctgtatttagtgccatttttcaaatagggaaggtgagaagcctgagactcagaaagtcttgccccatatccatgagaaatgaatggaagacaggaaatcaactctccttttttgactttaaatctagtggactatattaaattaagtggaatttttagaccatccatgcattcataaatttattccttggagctattcttttacttaaatagagctcaggtgtatgaaattggattaatattattcttaggtttatcacagtcatcgatagtttatgcatatccctaattttatgtgtgtatgcatggattcatatttgaatgatatgactaatacacatgaatccatcattcaaccttatacctaacatattgtcattagctatctatatctctatactactcttttcccatctcaccaacccttggtttactgcccaaccctaaagtatccgtattttgaattgcatgtttaccatttctttgtttgtttgtttgtttttacagttagtttagttttggttcatttttgcctgttttgaatgttgtattaaaattatattccatagagtcttctggaactagattttcttaattcaactttatattactgatatgtatccatactgttttgatatagttgcagtttcttgattttcactcctgagtaatattccattatatgaatataccagtatttatttaatcattgttttatttatacaaatttgagtcatttcagttttttctgtttgtttttgctgctatgaataatgctgccatgaatgatttaacattttgagggagcgtaattgccaggttgtaaattatatgaatgtataactttacaggagaatgccaagttgcttttacaaagtggttataacaatttataaacccaccaacaaagtatgagagatcctgatgatccacattctctgcaataattattattgccagaattgtaatattttatcaagcatgtagatgtaaaatggtatctcattttagtgttgatttgcatttcttcaattgttaataagattgagaatatcttcagatatcgtccttatgtatttttaaaaattatttgtagaacttctttttatttttgatacaaactctctgtcagtcatatatattgtcagtatcttttcctggttggaatcttgtcttttgagtctcctggtagatgctgttttcaaatgaatgttaactgttaccaattcacaactacatccttctcaaaagaactgtgcctggcaaatggacatgcctcacccaaaagtttttgtgtcctaccctgggttcagcctgcaaccaataattgatgaatacacagatacaagaggctgactcctttccctccaggaaatacttcctctgtggtataattcatgtgcccacagttttccatgggatttggctgacactagtctccagctgaaaccacatccttagtcaactccttcccctccctgttttgcttctttcatttccctataggttcttcctgagggcatttcctcaataaatcacttgcacaaaaatctccatctcaggttctgcttctaggaaatccaacttcagatactttctttgaggtgtcttttgatgaacagttctgattataatgaaatgtatcaaattttttattttatggattttcttttttaagaatctctatttacaaatccttccttactccaagatcagaaagctatcattatctgttatttcctgtaaaaaattgaaaggtttgctttgacatttgagtctttatttattttggagttgattgttttgtaaagtatgaggtagaaattcaatgtctctatatgtcagtaactattttgtccaggttaatttattgaaaatttcttcttttccctatcatgtatctttttagaacactgatagtttagtcaacatttattccacactttttaaatgctttttatttttatttttttattattattatactttaagttttagggtacatgtgcacaacgtgcaggtttgttacatatgtatacatgtgccatgttggtgtgctgcacccattaactcgtcattcagcattaggtatatctcgcccctccccccaccccacaacagtcccccgtgtgtgatgttccccttcctgtgtcccagtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtattccatggtgtatatgtgccacattttctttttttttatttttttaattttttattttttatttttttattattatactttaagttttagggtacatgtgcacattgtgcaggttagttacatacgtatacatgtgccatgctggtgtgctgcacccactaacttgtcatctagcattaggtgtatctcccaatgctatccctcccccctccccccaccccacaacagtccccagagtgtgatgttccccttcctgtgtccatgtgatctcattgttcaattcccacctatgagtgagaatatgtggtgtttggttttttgttcttgtgatagtttactaagaatgatgatttccaatttcatccatgtccctacaaaggacacgaactcatcataaactgctcttaagatcagtgcttgagttctgtagatgtctgttaggtctgcttggtgcagagctgagttcaattcctggatatccttgttaactttctgtctcattgatctgtctaatgttgacagtggggtgtttaagtcacccattattgttatgtgggacctaatagacatctacagaactctccaccccaaatcaacagaatacacattctcctcagcaccacatcgcacttattccaaaattgaccacatagttggaagtaaagcactcctcagcaaatgtaaaagaacagaaattataacaaactgtctctcagaccacagtgcaatcaaactagaactcaggattaagaaactcactcaaaactgctcaaatacatggaaactgaacaacctgctgctgaatgactactgggtacataacgaaatgaaggcagaaataaagatgttctttgaaaccaagagaacaaagacacaacataccagaatctctgggacacattcaaagcagtgtgtagcgggaaatttatagcactacatgcccacaagagaaagcaggaaagatctaaaattgacaccctaacatcacaattaaaagaactagagaagcaagagcaaacacattcaaaagctagcagaaggcaagaaataactaagatcagagcagaactgaaggaaatagagacacaaaaaacccttcaaaaaaatcaatgaatccaggagctggttctttgaaaagatcaacaaaattgatagacagctagcaaggctaataaagaagaaaagagagaagaatcaaatagacgcaataaaaaatgacaaaggggatatcaccagcaatcccacagaaatacaaactaccatcagagaatactataaacacctctacgcaaataaactagaaaatccagaagtagtggataaattcctcaacacatacactctcccaagactaaaccaggaagaagttgaatctctgaatagaccaataacaggctctgaaattgaggcaataattaatagcttaccaaccaaaaaaagtccaggaccagatggattcatagccgaattctgccagaggtacaaggaggagctggtaccattccttctgaaactattccaatcaatagaaaaagagggaatcctccctaactcatttcatgaggccagcatcatcctgataccaaagcctggcagagacacaacaaaaaaagagaattttagaccaatatccttgatgaacattgatgcaaaaatcctcaataaaatactggcaaaccaaatccagcaacacatcaaaaagcttatccaccatgatcaagtgggcttcatcccagggatgcaaggctggttcaacatacaaaaatcggcaaacgtaatccagcatataaatagaacaaaagacaaaaaccacatgattatcacaatatgtgtagaaaagccctttgacaaaattcaacaacgcttcatgctgaaaactctcaataaattaggtatcgttgggacatatctcaaaataataagagctatctatgacaaacccacagccaatatcatactgaatggacaaaaactggaagtattccctttgaaaactggcacaagacagggatgccctctctcaccactcctattcaacatagtgttggaagttctggccagggcaatcaggcaggagaaggaaataaagggcattcaattaggaaaagaggaagtcaaattgtccctgtttgcagatgacatcattgtatatctagaaaaccccattgtgtcagcccaaaatctccttaagctgataagcaacttcagcaaatctcaggatacaaaatcaatgtgcaaaaatcacaagcattcttatacaccaataacagatgaacagagagccaaatcatgagtgaactcccattcacaattgcttcaaagagaataaaatacctaggaatcaaacttacaagggacatgaaggacctcttcaaggagaactacaaaccactgctcaatgaagtaaaagaggatacaaacaaatggaagaacattccatgctcatgggtaggaagaatcaataccgtgaaaatggccatactgcccaaggtgatttatagattcaatgccatccccatcaagccaccaatgactttcttcacagaattggaaaaaactactttaaagttcatatggaaccaaaaaagagcccgcatcgccaagtcaatcctaagccaaaagaacaaagctggaggcatcacgctacatgacttcaaactatactacaaggctacaggaaccaaaacatcatggtactggtaccaaaacagagatatagatcgatggaacagaacagagccctcagaaataatgtcgcatatctaccactatctgatctttgacaaacctgacaaaaacaaggaatggggaaaggattccctatttaataaatgatgctggggaaactggttagccatatgtagaaaactgaaactggatcccttccttacactttatacaaaaattaatttaagatggattagagatttacaggttaggcctaaaaccataaaaaccctagaagaaatcctaggcaataccattcaggacataggcatgggcaaggacttcatgtctaaaacaccaaaagcaatggcaacaaaagccaaaattgacaaatgggatctacttaaactaaagagcttctgcacagcaaaagaaaccaccaacagagtgaacaggctacatacataatgggagaaaatttttgcaacctacttatctgacaaagggctaatatccagaatctacaatgaactcaaataaatgctttttatacatgaaaggccttgcatggagctggggatataaacataaaatgatacaactccccctgctgtcaggggctcacactatagtgggaaagtatatatatagtgggaaagtatagtgggaaagtgtgtgccatctatcagcaggaggagtcaggaaaaacttcttagaggtagcggaatgaaaaaacagaaattttatattttagagaggtggatatttcttggtgtttccaatttgaagaaagcgctgattgtaaaccagcgtatattatttcagaatattgcctatagttctatgtgacacaaaatgtgtgtacagaaaaaaaaaggtgtgtaccagaaaaaattttagaaataggcaggagtcgacttataaagggctttttttcttagtggaactttgattgtaactcccagcacaaccatcttctctcaacaggtggcctccactcttgccactgccttggagagagtaatgtaacccatagagagccgaaatagcctagtgttttggacatggacattggtctatgctttggtttaaatatcccctccaaaattcacgttgaaacttaatacccaatactacagtattggagggaaggctttaagacatgattaaatgatgagggctctgtcttcatgaatgaattaatcattcatgggtgaatggattaatgggttaatagatgaatgggttatcatggaaaggaaactggtagcttcataaaaataaaagagacctgagctagcacattagcattcttagccccatctccatgtgatgccctgtgctgcatcaggatgccacagagttcccacgagcaagaaggctctcgacagatgcataccctcaaacttggacttcccagcctccataactgtaggaaataaatttcttttctttataaactgcccagtttcaggtcctttaaaacagaaaacagactaatagagtttaaaagtgggcatgtgctgcaaacaggtccgatcggagtcctcctgtaggattagcatatggaagttacatacccctgcagggtctatatttgcttgatcatgccaagcactaggcctactcatatcacctcccttcccttccactctcctttaacaatacacatgactcaggtacctgtgttaaatggtgtaataacactttttaggattcttgaagaaatgacattgatatatatttttattcttgataaaaatacaaaaagaataccctttaaaattttgggtttttttgctataaattattattagagattattataaaattttcagagaagattaaaaagcattaagaaaattaaaataattcacagccccaacaattaaagaaaaatacagttaaatatttaccgtcttatcttttaggttcacaaatatgcagatgtactggtttaaaaaatacaattgaattcattctattttatagccaaatgttataccattattaattttttatacaacacaaatttgaatattcaattaccacatttcatagtatggttatactacttagccattagtctgtttttgaggattttggttgctttcaattttcataattttaaagaatgctgccataagcattcaatatgtagatcttctgcattttagattttggattggataaattcctaatggaattgctgggacagaggttatatacattttaggactctttccacacgagaactttgcaaattagactatatgttttatttcagtggaatatgacaagtctgtagtaacagatgatcccaagtcccagaattttgcagtacttaaaaatgcagggcaatcagattcagccgtacttcagcatttggggcataatgtgatgggctgatttctgtgctcacactacagtgtttcagactgatacacattctccaaagcttctttttcatagaaacaaaatattctaagatgtgcagagctcaagatttgaagtcttagtttaaattttccatgtttctttgagggtggggtggagggtgatgtatttttccttcctgaagatagttctacaaatggattctatagattgaaggcctatttttgagaattaactataccaagaattttacatttataatctcatttaaccccttccaataccatttgagaatttaggtggtatgttaggaaacaatacaggttttgaaaccagaccagtttaacttggcgaatccaggttttatcaattgcttgctgtgttactttaattgccttctgaaaagtattaatttctctaaggtttatctacaaaatcatgcaggtatgaataaataccttaccacgtatatgtttcaattaaatgagaaaatgcgggttaagcaatcagcatagtgtatctctgtattagtctgggatcctctgagatcagaatctgaggcatgtatatggtttattctggaagtgattgccaggaacaggactgaaggtttagggaggagaacaggaaataagggaaaactgatacaaggatgtttttaagttgggcactggtgcagatgattggctctgaaccttccttctgtggagtgctgtgaaatgcatcttagaactctttgcctaaggaaaaaaaggagaaaaatatttattcttcagcaaccatcccccataggttaagaataatcccagggcattacctcccctgcatttccaggttgtgtgtatctgtcgagttatgcaaagaagcctgctgcaagacagatgaggggcaaggcacagctggttgcatttgcacaaaactagtcagaacgggtcactaccatagcagctggggcaaaaggtggagtctatgaggattttcagggacacacaaggggtgtctgtatttcctattgctgttataacaaattatcacgaacttagtggcttaatgcaacataaatttattatttcacagtgctggaggttggaagttcaaaaagtgtctcttacgtggctaaaaccatgatgttggcaggactgcattcctttttatggctctagaggaaaatctgtttcttgcttttgccagcttctagaggctgtctttattccttggctcaggctcccttccaacagtggtgtcactctggcctcacctctgtcatcatacctctttctctaatcctgacactcacttttatgtgaactattgtgattatgttaaacccagctgataattcatgataatcttcccaattcaagacccttaatcacatctactaaatctattttggcatgttaggtgacatattcacaggtttcatggatcagcacagggacatctttgggagtcattgttccgcctaccacagggtcagtgtaggcttctagcacacatttgttaaggttcccttctcctactgcttgctgagtttccatcctcctcaaccccaactgtattaattaaggttctccaccaaaacagaatcaataggatgtatcaatacataatgagatttaatatagggtattggctcatgcaattgcggagtctgagaaattacacagtctgctgtctgcaaggtggagacccagaaatgtagtagaagggaactacaaatgtgtagttcaaaggcctgagagccagagacccagtggcatagattccagtttgagactaaggcctgagaacagaaacaatgagagtaggaaaagatcaatgttccagctcaagcagtcaggcagagagccagcaagttctctcttcctccacttttttgttctattgagtccacctacattaagaaggactattcatttgacacaacctattgatttgcatgttaatctcctctggaaacactctcatagatacaccccaaaataatgttttaatcaggtatctggacatctttttagtcaaatttacacatataattcactatcatgcaacctgtattagttcattttcatgctgctgatgaagacacactcgaaactggcaacaaaaagaggtttaattggacttacagctagctccacatggctgtggaggcctcagaatcatggtgggaggcgaaaggtacttcttacatggatggcaagagaaaaatgaggaagaagcaaaagtggaaacccctgataaacctatcagatctcgtgagccttattcactatcacgaaaatagcctggggaagacagcccctatgattcagttacctccccctaggtccctcccacaacacatgggaattctgggagatacaattcaagttgagatttggatggggacacagccaaaccatatcaccacctgacataaattctgataattcacatagctagtaattggacaggcaaagccacaaatccatatgatgtggttgcaaatccattgatttgggggattttagagtcaaaatctcattggtgggcgtggtaaaggacagggttggtagtacttttgctagcacaagggcatgtgtgattcagggctacaagaatgagccaatgtgagagagaagaaatttgacccaaaggctgcactagaagcccctccaattttagattccatttccagtgtgatgatactaaattgttttcaatccacaaggaaagaaaatttactgtttttaagttgtccataatagataactttgactaaaagataaagttgctaaatctaagacagatcattgttcatctaaaatattaaataaatactgaataagaaatattttagcatgatttttaacaggacaaaactttgctcaggtttttggtgaaaatcaacactttaatgaaatatatgggatgaaactaaaatacaggtgctccaatctgaatatttataacaaatgatttataacaaatgagtaagtgtaaaaagtaaataaaataaacatccacacaaccaccatttagctttaaaaaaaattacattaccaataccttaagaatgcccttgcttttctgatcccattccctaccctatttcctaactgtgatcactaccctgagtctggtatttattattccctttctttccttgatagtttttttaaataatctacatatttctaaataatatatttttagtattgtgtataggtgggatgatattgtacgagttgtgctattcaatcatgctgacttatataactctatctgattcatttgttcatttgtactgctgtgtattaattcactcttgccaatggatatttgagttattccctctttggtgatatttattgtctttttttgtttttgattctctcttaaatattacaaattatgaacacgtttgtacttgactcttcatgcacatgtataaatttattttttaagtttgaatccaggaaaggaattatttaattgtaaggcaggcacatggacaatttaaaagaaaattctattgattataaaacgtaaatagtcaccaacagacatgtgagttgttttattctacattcttagcaaaacttgatatcagcaggcttttaaattattgtcattctagcaaatgcaaaatagtatattttatgaaatgttaaatagatacaaatttatgttatgaaagcacttctgtgtcttggttataaaattttcttccacccaaaggtcatatagatattctcctatattgtcttctaaaattaaaataaaatctaaaatgactcactttcaaatttaagactttaactggaatagatttttatacacagagagaaatctaatttaattttttatataaataactatttttctagtatcattaagttgtctttcctttacacaattatttgtactgtaagttttattatatatcatttccatatatttgtgggtctgtttttgctaattctcttctgatttaattgatttatttttctatctttaagtcaaaattgcatttctaactaaagtgctttatgcaaagatcttgacatccaataggacatgttttctgctttctcctcccattccttcaggggtgttttggctgttgttagctcttcctccttcacaaaaattttagaatcaatttagaattttagaattaatttgtcaagttgtacaaaagtcttggtaagtttttgacttaagttttaagagagaacttggtagctttaaactactggactctttctgtttatgaacgtggtataccttaccttcccattggtttaaatctcttttaatgttattaagttttataatttttctttatgtcataaaaatctttcttttatttcttcttataagtatacatgtgaatggagaggtgaatacattgtatttttgctgttattgtaaataatatcatttttgcattaaattttctaattctcattgattaggcatgggaatgcaaattgaattttatatagagctattgttttgatcaacattgcaaagtttcctgttcaagtctagtagtttatcagtacatgctttacattttatatggaaacaatgtatatgtgaataataacagcaacattatgctgtccttttctaacttttctatcttctataaaagtatttctaacttttatatcttcttcttgctttggacttccagaaaattattgaaaataagtagttatggtgagcatttttgtcttttgtcttagtccattcaggctactataacaaaaaactatatactgggtagcatgtaaacaacagaaatttatttctcccagttctggaggctggagagtccaagatcaaggtgccagcagagtcaatgtctcatgaagaccaattttctgggtcatagaagatgccttctaactgtgtcttcagatggtgaaaggggaaaggcaggtctctggggcctcttttataatggcactagtcttttccatgaggattctaccctcatgacctaatcacctctcaaaagaacccaccttcttacacaatcatacaggtgactatgttttcaacatagaattttgggaagacacaaacattcaggacatggcatcttctatgtatttcaacatgtacttattaaatatcacttctgattctagtttaccgtaaattttatcaagcatggatattgaatgtcagtgaatgcttcttttatacccgttgagaaggtcatgcatttttcttttgtaatcatatgctaataaaattaatttatactaattggttttttaatattaaacctaccttgcagtcctggagaatctaaacattcataatgtattatacatttttagattgttcatttatttttgctaataccatgttaaaaattttaacatgaatagaaataatatgtatttcttattacttccactatttttaattttgatatcaagttactcattcaaaatttctgtgttgtaaataaagagtaagtccacttacatcaatggaaattactaattctactttctaccacctaatttttatttgtcttgctttttccattttttcccacgttcttgtctccctttaaattgattcagtcttttctctattattaattctctaatcttctccagttggagagtatacactttttagctgactttgtagtggccacttataaatattttgccaaatattttacaaagtttaaaattatcgaaggaggctgaggcaggaggattgcttgagcctgggaagttgaggctgcactaatccatgattgcaccactgtgatgctgtcttaaaatgaaataaaacaaaataaaataaaaatttatatatttgctctacttttgaacactgggagaagcttacaacacttgaacatctaatctccatccttttccaaactatatactatttttgctgagggttttagttctatttcattttcataacttctctaatcattattatttggtagttttgtgtcgtcattctgaaatttaggtatatcctcatatatattagtatcttcatatgtcatgccattgcatattagactttacaataggggtaattttccttcttactgacaataatgctagttctgtaatttagtaactttgtgaccttgaagcaaattacttaaagcttttgcgcttcttcagttttttcatgaagtggaaataataatagtatttatttcacatctactgagaagattatttatatggtttggctctgtgtacccacccaaatctcatcttgtagctcccataattcccatgttgtattagtccactttcacactgctgataaaaacatacccaagactgggcaatttacaaaagaaagagatttaatgacttactgtcccacatggctggggaggccttacaatcatggcagaaggtaaaaggcacatctcacatggtggcagacaagggaagagagcttgtacaaagaaactcccccttataaaaccatcagatcttatgacacttattcactatcataagaacagcacaggaaagtcatgcccccatgattcaattaccccccaacagatccctcccacaacaggtgggaatttaagatgatatttgggttgggacacagccaaatcatatcacacgtggtatgatataccagaaaatgtggaagaaaatgctatgtggaatattgtcaatcatcctactagagagaaaacaagcactggaggatctcactgacaattaaatgcttagcccaaagccagagagacacattagtttctctcacaagacactggccagaattggtcacatgggaatccaggcagtacaatcttactatgggccaagaagtcagagagttgagactattcagtgatcagcataaataaatagtataccatcctttataattttctttcatttttgccttaaaattatactagcttaatttcctagattcttgctttaactttttaagttttttattcctcttaagatttcttattttcttgccactttgatggtgtattctgaagtttcattttatatattattcattggtttggggggaatttgttcatttaccttttagatgaaaggcttttttatatatctggtatactctagtatactgctccagagataatgaaaatagaaattttaccactcactttcaaagccttgaaaaaaatgatccaaatcttaatggaatcataaaaccacctttctatggtggtcctattatctaaatgtcaggagaactactcctcattctatttcttactaaataactttgaaaccatggtcagatcatttcccctctctggacctactttccttaactataaagcatctaggtagtgtaaatgacctttcaggggctgccccaacatactattcatttatcagtttatttcacagtagaacatgcattctataatgatttttaacaatctcaaattccaaaccaaatatttctttttcaatggcaggcttgttgctacttaaagcttttcatggaagctcttgactcaagaatgctacaaaaataggctcttgtcctcttcttgcatcttgcagatgtacaacattagcataaagagatgttggaaaaaaggtgccctcttctaccatgtagttcctttgctgctacgtgaacctcatatattctcacctccttcttgaaatacttgcaacagagtacataaaggatagctgaacattctttggagaggacaattgtagtttaatccaacctttgaaaaagctttgctcctcattcaaattctttagatgctctcagtgcgtaaactacatgtcatggtacatacaaaagggaagagaaaaacacaattgtcatggtcagtttgagatgctacaacaaaaatgccatagactggtagactgggtggtttaaacaattacatttatttctcacagttccagtatctggtgagggctcacttccttgtttgcagacagctaccttcttgctgtatcctcacattgctgagggagggatcccgtgtttcttcctctttttataagggcattcatctcattatgaaggcctcatcccaatgacctaatctaatcctaattacttcccaaaggccccacctgcaaataccatcacatcgaggactaaggttttactgtatgaattttgtggggaggtgaggaatagcagatgaaacacatttagtctggagcaacaattaacattgttttaaaaaaccaccatgtctttcaaaatatatgtattttcccctaatgattacatttatttctcacaacaatccttgaggtagatattgttatacctccttttggatgtgaaaactgagttcacaaaggataattaagagattcaagacttcacatttgtactgcactgtctaccaaagctcatcagtgttactgaaattacatgagagatataaatctaagtaaatagaaccccctgcctcatggtaataagtagaagactcaggtataaggcaagaacaactccgtcaagatgaggaaacacaggcattcacatacccgctgatgcatgaggatagagagcatggcctctgagctcaggaagactggattggtttaattcccagagctgaggctgtagtagatttctttttattttctttaactttatttatttatttatttgagatagagtcttgctctgtggcccaggctggagtatagcggcacaatcatagctcactgcagccttgaacttctgggcttaagcaatcctcttgccccagcctcccaactagctaggactacaggttcatgccactgcacccagctaatttttaaaatattttatggagatgaagtttcactatgttacccaggctgatctcaaactcctggcctcaaacaatcctcctgcttcagcctcccaaactgctggaattacaggcatcagctagtgtactcagcccttagctttctttctgacataattttagatttaaagaaaatttaaaaataataatagaaagaattccagtatatcttctcacagagtttttcagtgttaacacattactacatttgttttatcactcacaaacatacacatatttttattgaaacatttgaaattaagttacagacaagatgaccattgattattcaatgtgtactttctaaaacaagaacattctgttacataaccacagtataattacaaaatcaggaaattaacactgatctacttctaccatttaactgtcaaattgccttggtgtttcactccttgttcctatattgctctttataacaaaagaaaaagttggattatatgttgctttcaaaataggccaggcacgatggctcacatctataatcccagcactttgggaggctgagtcgggcagatcacctgaggtgaggagttcgagaccagcctgaccgacatggtgaaacccccatatccactaaaaacacaaaaactggccgggcgtggtggcgggcgcctgtagttccagctactcaggaggctgagacaggagaatcacttgaacctgggaggcggaggtcgcagtgagccaagattgtgccattgcactccagcctgggcgacagagggagatgctgtctcaaaaaaagtaaaaagaaaaaaaaaaaagtctggtggctgagtgcagtggctcacgcatataatcccaaaactgggaggccgaggtgggtggaccacctgaggtcaggagtttgagaccagcctggccaacatggtgaaaccccctctctactaaaaatacaaaaagaagcctgtaatcccagctacttgggaggctgaggcaggagaatctcttgaacccaggaggctgaggttgcagtgagctgagattgcgccactgcactccagcctgggcaacagagcaagactctgtctcaaaaaataaataaaataaaataatagcttagttattttttagtatacctctcatcgtggggtcatctggtggtttcttatgattagtttcaggttatgcactcttgacagaaataaccaagaagttatgttgtgttttaaacatgcatgaggtcaggagggaaatgatattatttgtcctattcgtgtagatattaactttgatcattggttaagatgatgcctgtaggcctctccagtgtaaacatgtcatttttttcatttgtaataaatatttttttcattttattttattttattgttgagacaggatcactctctgtaacccaggctggagtgcagtggtgcaatctcagctcactgtggcctcaacttggggctcaagcgatcccttctacctcagcctcctgagtagctgagaatacatacacgcactaccacacctggctaattttttttttagagatgcggtctcactatgttgtccaggctgccattgaactcttaagctcaagtaatccttccacctcggcctcccaaagtgctagaattacaggtgtgcaccaccatgcccagcctaagtaagtatttttatggagcaaaacttttggggctagataaatatcttagtcccattaatgtttcacccactagctttattatctatttataattcttcctttaagcaattaatactgtgatgtttgcaaatgatttctctaattttatcattcctgcctcatttattaggtggccttttactccaaggaagagcttttacttcttccacatttatgtatttgtttatttgtttatatcattctgtatatctgtatggagttcatgttacaagtttcctaaccctcaggaacctcagttcctcctctgtaaaatggcaatgaaaatatttaccatctaggtttgctgtgtagattaaataagctaatataggtaaggtcctccaaatcatgagaatcacataaattggagctacttatattagtaataataataataatacttgtctgacttttaatatagtgagaacagttcagggtcatcttctgtcagtactttatgaacttgaacgacccatttaacctctcttgctctcattcttctcacctataaaacaaaagagttgggttacatgatctctaaattcaactacaattttaatgtaagaaactaagattctgtacctataaaatatgtgtgcataaattcattttttccaacaccctgtgaagtattctgtattatctttgcagtatgaatatctttcataactcttagtgttcttctaaaatttcaaaagacatataataatttatctctgaataaacagtttgagtgttccatttaatactttatattttaataatgttagttggtcacagctattttccaactaagcagatgactttgacaaaatgtgaaatagctaaagacagatggtttccagctccaactgtttgggtttattttccaatgccagcaaggtcagtgatccttcaactgagtgtggccttagaccacatgatggctatgatttgcatattacagaaagaatagttcaaacactttaaatttcattctaaaacatatgagtcacatcataaaatgtgaccagtatagcttggaagtttattataggtaaccttgaacatgtctttgcacattgttgaaatgaagagtatattaatagccagcaaatggattaatctcagtattaaacacttcccaaaggagagggtgctgaggtaacagaaagaacccttgaattcctaggcttaaatcttagttcttactagtcctataaactgaggcaaataagtttctgtgtctttttacatcaaactgaaataacatgtggtatggtttggatttgtgtctctgcccaaatctcatgtcaaattgtaattcccagtggtggaggtgacgcctggttcgaggtgactggatcatggaggtgtttctcatgaatggtttgacaccatccccttggtgatggtctcatgatagcaagtggattatcatgaaatctggttgtttagaagtgtgtagcacctcacccctcactctctctcttgttcctgctcctgccatgtaagacatgcctgctcccgcttcactttctgccatgattcttagtttcctgaggcctccccagaagctgagcagatgccagaatcatcctgtacatcctacagaactgtgagtcaattaaacttcttttctttatgaattattcagtctcaagtatttctttatagaaatccgagaatggactaatacaacatgatggatctcatagggatgttgtgagaagaaaataagtccattttaatgagatcacctagcatataaaagttgcctgtatagtgtccaataaatatggggagaataaaaccaggataaacgaggtccagaatgtatagtatagcaatcttttctttaggattttttttctaaactgaacttggaattaaatttggaaagttaagaagtactatgttccaggttgagcatctgaagactcaagagagtaactgccttatgacatacctagtccaagtccagcagcaaggctgggtgtgtcataatcacctcagtggtactcagagtcataaatcttgggcctcatgttgaaaattatgcatgagtaaatctatagaaaagtccaagtatctgtatttttaagcacttaccagatgagttttgtgtttcagaatccctgttctaggagacttaagaacaggctgggcatggtggctcactcctataatcccagaactttggaaggccaaagcgggcagatcatttgaggtcaggagttcgagactagcctggccaacatggtgaaaccccatctctactaaaaaaaattaaaaaatttgccaggcgtggtggtgcaggcctgtagtcccagctgccagggaggtcaaggcagaagaatcatttgaacccgggaggcagagattgcagtgagctgaggtcataccactggactctagcatgtgtgacagagcaagactccatctaagaaaagaaaagaaaagaaaagaaaaagaacaatgaaaaacatatcaagtaagccactagatcatcaagtggtaccaagattgggagcgccttatcagctaccaggagcacaccactggtgctgactaatggtctttaatacttaaaattatttcgatgagttgcttcacatgtcaggtgcaggctctagtctcaaactccctgggttttaccaagactttaccattttccagctatgtcatctttgatagctagttaatataacatctttgtgtctgtttcctcatctctagaatgaagattgttgtaaggtttaaatgagataatttgtgtgcagcacctaataaaatgctggcacagactgacaaacaaatggatgctaattgtttaattatcctgaagttcaaatgaagacattttgaacaactatgcctttatatatgccatttcccatgtttggaagcctttcccacacttttccgcttagtaggctcttccctagcattcaagatttaagattctatgtgggaatgtccttctctgctctctgtatgtccagctctgcccagtgaaatcctcccacgaagcaaatcttcttgctatgggaaaaaaaattctgatcaattgcctgccaagtcctaattaatctccacctttcctgccctccatcacacagtgtatgcatgctatctgaattgaccttagatatgtaagtcttccttgtggtaatgtctactttctttgggtgagctgttggtttctcacatctttaattgtacatgttgacgatgccaagacctgtttctcaaactcatactattcccctaagcataagacccatatagctatcaatcttctgaaaatacccttctttatgtcttgtaaacactccaaattcaacattaataaaatcaatttacctttcaactacattttttcctatattctcctttgtgccactttggaaaatagtttggcagttccccaaaatgttaaacatatagtaaccatatgatccagcaattacacttctagatatacacctagaagaaatgaaagcatatgtccacacaaattcataacattattatttggaatagccaaaaggtggaaacaaaccaaatgttcaccgactaatgagtagataaacaaaatgtggtatattcatacactaagataatattcagccatgaaaaggaatgacatactgatacacggtataatgtgcatgaaccttgaaaaaatcatgctaagtaaaagaagctagacacaagttatattattccacttatactaaatttccagaatatactaatccgtagagacagaaatagattattggttgccaagggataaaggaaggagggtatgggaaatgacttctaataagtatgagatttattttgaggataatgaaaatagtctaaatagattcacagctctgtgactaaattaacaaccactgaattttacagtgagttttttggcatttaagttatatctcaatttttttaaaaaaatgatttcctatgatttccatgtatgacatcattactccatcactattgcattcattaacagttaaaattttggcaacattttggcttcctgtcttcctaacatgtaagaacattgtcaaatacttatagttctctcttcaagttgtccccctgatccattacctccaaaaaagggatcatcttaaatataagtataggggaagaaattaatattcctctgtacttatataaagctctatccttcatttatcagtatcaagacatccctataataatgagagaacaaaataattgatttgcccaaaggtatataaccaagctggtttgatacccaagacctttggttctaagtcccacatttatttcactgcattacattgtgcaatgttacatgaacacatgtgcaatcactaaaagtatcagcaacagggaggacaatccactgcatctaatcctaaaggaaggaagacaaagatcagagaaatatgggtaacctcccattcagagctgttaagaggagagagaacgaacattacttgaaggtcctctgacttcccccagctggagaagtaggaattgttcaaacaccagtcagttgataaggaaagagcatcccagctttgctaatcactacctaataatcacattttctgaatttcaatgtttgttacacaaagctatttttatataaattaatcatcaaaattctagatcaaagctgctcaatctggagctattttgccccccaggggacattcattaatgtctggagatatttttgtcacaattgggtaggggttttttgaggggagaagtgccactggcagatagtcagcagaagccaaagatactgctaaaaatcctacaatgcgcacaacagctccccaaacaaagaattgcctaatccaaaacgtcagtcgtgctgaggttcagaatcactgttctaaatgcatttttcagttactaataattgcaagatgtattcccaactggcagacctctgttgtttgattgtagaggacttccacaaaaataatctgtgaccccaagagcctcaggctttactcaaaataaagagttcttgtggatttaattcagttgaatttaaactctaatgtttacctactgtgctggaaacacaaggctatgaactattggggatatatgcaaatagttataacatgctccataccctttggaaacttataatttattaaatgtggcaagttcctagagaatggggactatgttttcttagtacctacatgataggtgttttacaaatatttattaaatgagtaagaaaagcctctcagtaatttttcaaaatcttccccactttcatagatgtcaatgcccaactgcaccatctcatttttgtcagactgctttgccttttacttggtaaagaaaaatggaggttacagcatggaccaactgtagcctcttcatcccctcatttacttctggacccatattttcctcctttcaagtttaagaaaattaggtgcctctcatcctacacaaggccaactctttcactgttttcatatccctctctcctaactctattatcttccagatctgacccagtcagtaatcaataatacctactttgtgtaaagtacatgattcagcaatcaaaatatagtacatgttcaatgattatagcttttatattccctctccagtccaaatttctccagtctggaaataaaatctccttttaatcttgtatccacctgtattgtttttcttctctttaaagcttactttctttgtgtccctactttcttatttctcattcattttacattctgaaatcttattctgcctctcccactcactgaaactacttgtgaagaggccattcattgatgatcttcatgatgcaaaattcttagctgattctttgactcctgaagcatgtgccctttcctacaaaaatgactgtatatacccacacaaacaaacttttcataatattttcaaagaattcactgagacaactattgatctagtttaaaagcactgtagtttacagaatttagtcctcactggaaaactctgttgcatttaacactgttttatctccaatggatgcctgagacaaaagatgaggaaacattctacaattacttcttgagcaactattccatgccagatgttgtacagcatactaaaagaatagaggtaatagaacaaggtccccctctcaaaggaactcacaatatgtatttttgtgaagaaggagtgagtagctctgaaatttcaaacctgaatgcttgggaaagtggtgatgctattcattgaaaaagagaaccaagggaaaggagtgatttaataattcaggtgctgagtttagccttggacatattatgattgaggagtaaataagatatccagatggagaaattcaatattattcagaaattggtgcgagaaagggtgttgggagagaaagggtggtggttagtgctgtctggtgctcataaggaagatttgaccagataaggtgaacctaagtcaaggctgaaactagataagattccaaagttctcattctttagatagcctcccagaaagaaataaaaatttgcggtattttggcaagaaattcaaaatataagcagattgtgaacaaagccatggtcactggtgttagatggatgtgatgtatctaaacctaaatgcataagatgcaatgtctgagaccttgaataaatatataaccccatttaagtgctaatatcctcacctagcatatcatattgagaataagtagtcaaataacacatatagaagacttactataatatacagtacatagtaaggagtaattaaattataataatatcattatttttaactattaggatttgatttaattaaatgtccatttataatttcttgaagacctggaagccaaatatgcaaaattctccaaatatcaatatttttctgattgttagacaccatgttcagaaaaaagagccaaaaaatcatatttaataaagtataatttcctggcatcaattccttgaatgttctgtactttcatctatatataggatgatgatatttcatgtccatatttatgagcctaatgctctaagagtttctcagttattttaaaagctggttgaaattaataaagtgagccatttattcattcaacaaacactcattgaatgcattctatatgacaagcattgtgacaggtgttgggaatacaggacagagaagactatgatgtcacagagctcacaacctagtaaggttataaataccatcattttactaatgtgtaattagctttgataagcatcatggataaaaaatatagagagttatgaaatcatgcagtaaagaatctaatccttttggagattcaaagaaagtttccctggagaagtgatatttgagctacaatctgaagattcagttgggtaaaaggcacaagggaaagagttttccaggcaggagaacataatacgttaggacactacatagggagggtgcaggataacttcgataaagagaaaaaagagaaaatatggctctacaacttagtaaatgtgctgacacatgtgccactcagattcctgttcaaaaagactttctccgagaagcatggctgactggcagcatccagacaaagcactctggatccagcaaagtgttcatagtgaggccaatcttttgccaagttgctcccagccaatgactgagtgcagcatggatactagagccaggtcattaccacttgacatgagacatgcctctaacaggcaatctttgtttagggacttcccatcagcctagccaacattttctcataattgtactgtggtgtgaggcttttcccatttatcctccttcctttcctttctcttcctacagctttcaaatccatgtagtgatctgaaggcccctgttcactttccctttatcatgcacacactttagatcaaatccacatgtataattctaactttacagtaggctacctctggcctaatttaactttaaaaattggtggctctgacataattaagcccataatgggtagttccagaggcatgttcttttggtgcctcagagacaagccttatgtctctgctagggcccagtaacacacaaggaactctttttcaaaagacatatcattctccattgcagatggcatagccttgctccagaaccacacagggctctgctgtgattctgtcaatggggcttaccataataaattccatacaacatctttttccaccactgatactcccagtaacatagggtctgcaaaagcagcagggttgcttgcactacagctgaatctgctaccattttccaaggccatcaataattcattagtgagaggggtaccaacatcactcctctgtaggccggggctgaccggtagaaaagaaatctcaaagctgggctccttagtaacccggggcatgatggagtccctatgacttgtggtgacaatattgaaacaccagaaaccagacctactgtgacctggggattccctttgactagggtttgttcctaggtccataatggtgaaatcatcaaacttacggcatttaattctctattgaagatggatgtcttgtgccaggaactatctgtcccccacattccactcaggatggcgtcctcattgccagccagttaatgagtgagccagtccccaaatctctgttttctcagaccactctggatgtcacctggttttccttttagagcctcagagaagcagaccacaaaatgggattccatgcacaaaaaaatttactggggaaatgtgtagctacataacagtcaaatccaggagtggactcaaaagacaccacaaagagaagatcatcactaagctatgcgcagtgaacctcttcatccataatatgtggaaggaaaagtagcctggagtgacaatattcagagtttcttgggcaacagttattagttaattacctggccagattgtagacacctggatgtaaaagcctgcaagattagagacatggcaatctggaataggggcatgtggatggacagagagccataggggaagtgagagaacatgaagtaacaaaagttttgttttacacatgaacgtacatgagaaagcacctaccatgggaaagacactgaagaatgaagtagacacaatgagtcagcaagttgacataagccagcttcatcattagccaccccaaaaccggtgtgatgaacacataaatggagaagccacagaggcagaaatgtagaaatccatgcacaggccaaacagcatggatgttctcttaccaaggctggttaaacttctgttgagtctgaatgtccaacgcatccagccatttcatagcaagttggccatgttgagtctcttccatcctagatggcaagctactctatgggttggtttccctgcttacagagatttagccagtaccacaatctggggacacaggggatgtctgattcacaagcatggagtatcagacagcatagcatctgacaaaggagccacctcacagtgaaagagatacaggactggacccatgactacgagattcaccggttggttaggaacaaaaagtaactataacacttttaagtacttttttatattaatgtccacagcatttccacccaacaaaacaaaattcagcaagtttatgtggctttctaacaataatcaccttccagtttccaataacatgttcctcatttccatgtgagttttcaccagaagcacctgtaacattcatattttcacaaataatctcttcaaagcaataaaggcttcaaaattcttcaaacctctactcattacccaattctgaattccaaagccactcccacattctcaggtacttgttacagcagcacctcactttccagtacaaaactctgtattggtttcctaggcaacaaagtacaaaaatataggtggtttaaaacaacagaaatgtattgtctcacagttctgggtgccagaagtgcaaaaacaaattgtcagcaggaccatgcaatcattccttctctcttctagtttctattgcttgcaggcaatccttggtattcctcaacttgtaggtatattgctccagtggtacggctatcatctccctgtgtgtcttcacattgtctttcctgtgtatctgtctctgtgtccaagcttccaaattttataaggatatcagtaatactcgattttaaggacaccagtcatattggattagaagaacatcagtcatactggattagggcccactgtaatgacctcactttaactttaactcctctgtaaagattatatccccaaataaggttacattgttagtctaactgggaaatagtatctcaacgtctgaatctaaaggtacagcactgtggaactcaattcaacccctaacactatgtgaaagacattattagttttttgggccacaattaatgtccagtcctatttgaacatatggtttccctagaaggccacaagttgaaaattactaaacttcatccaatgtccttcattttacaaatggaggaaatgaaacaaaaaacgaaacccaaaacctttcatttgaaatccagcccagttgtgaccctacttcactcccttgcttactcaatttaaacagaagagactccattcgaggtctgttcttcaagtaattagaaaactcaggtaataaaatgcagcatctctatgaactgtaaaagtcttttattgtatacaaatatttttaatcaactaaatggaaaaaaatagtgttgtagaattatatcagttacgttaggtaagctattatgtagtaatataagacactaaaattgtattggcttgcaacatcaaagatatatttctcactcacattacatacctgtcatgggtcagctctgtctttagtctagtacttttatctagtctttttatctttagtctagtactcagagtgaggagcaacccctttctgaggtatgcagttttcctggaagaaaaggaaaggaggctcagatatacagcatctacctaagactagactagcaaaataaaaaaaaaaaaaacaccgccatcagcctaacatgcaacaagtagcaagcaatggcaatataccattgagggaggtgaaaaggcatactgaacgaacacatggcacacagcgtagggaaaccttaaatgtgagattaaagtaagtacactgagaaaaacacttcagcaccacaactctcaccctaagctcaaggcatgttagatgaaagcttacagtgcattgaagtaatcatagcaatgaaacctaagccccattcaactcctaaccagattttctcaaacctccacattatttgcctaaaggataaaatgtgcattcatttccaggagtaaatagtatttactcaagtttctactgttctggatgagatagctgacatttaagataaaattacaaagacacaaaatgcaagtgaaattgacccattgtcacgagaaaaaaaatttaacaatacaaaaataagaaataaccaaaatattgggctttaaaataattatggttgatatgttcaagaatttagtggaaaaggtagaaaacatatgagcactagtgggaaattttagcagacaaataacaatgggagaaatataaaaggacttcatctgagatgaagaattccattgtcaggctcatcattaattttacacagccaataaaataatcagtgaatttgaagataagacaattagaaatttagaaattacccgaatggaaaggaaaatattttttaagtgaaaacaaataaataaaggaaatgaacagaaaaatagaacagagtatgtaaaagctatgtgacaatattaaatggtctaacatatgtgtaactggagcccaaaaaggaggagagagagaggcagaaagaaaaagctttgaaagaatagcatccaagaattttgcaaaatataacaaaagacatcaaaccacaaatctaaggacctcagaggaccttgagcaggataaatactacatgttatactccatttggcttattatctcaagaaccttgtaaagtaggcaaagtgaatattcatattttataggtgaggaaggattaagtaggtttcatccacattcacatagttggcctcaaggcagaactctgaaaacttctagggacttctttgccccatttccttcttttcctttccttgaattttttttgctgcctctcccatgtacttgctgggaagtcttggacttatcacttaaatttcacttctttttttttttaaaggactctattagtacaggattgattcctgaaaatatatttaaagaaccaggacagaacttggggaataattctgcactctacaatccccatgactttggggtgtgggcaccatctgtgaatctgctttctttctgagttatgggcaagatataagcatgggtttcttctactcctagattccatatttaccagagaattctatggttcctgttccttataatggctggaggagaaagaggaatagggcaggccttatttggtgattaacttttgtacattatattctccaactgttctttttttcccctagcttggaaaattatatttgtctaggatatttgtttattagaggtgattatgcgggaggaggtttggagcaaatttttccttgtctcatactctaacgtcttccaagtatttctctgttacacctaagctgtttttttaaaatataaaaattataatttgattttttaatttttaatcttcatttcctccagtgacagcctacctttgcagcaatactggtttcttatttctgagtctaaatggaaaaatgtcacagagtaaaacagatgtgcacaggaaaagggagaaataaaagcacaccagtttattatattgcatactatcaacattgtcattattgtcaatattattgaatcataattagtttaataaacatttctttattgttcctaaaagcaacctatgcacattgtatccataaaagccaagtaaagcatgctgtggacactctggcaatcatctagccacctcctaaattatttatgacatagctcctgtatcctttcagctcctagctcctggcccttagcttgagggcttcaggtatccctgaattttggtttccctgcctgggttcagaatacttaccgctgaactattgactcttcccttcctgactctttcaactaaaagtcactaccctttttttgcccccagggacgcaagcctcagcacagatcctgcccagctgacacacagactattttcaaggttgggtgataaaaacattgtaagggaataaagaatcaatggctccagccaaagtttctcccgctctttttgtctctttctttctgtctgaaagaaaaaaaagatgtgctccaaagtatgcaaacatttattgtgaaacatacttcccctttctgtataaaacgatgtaaatacatccgctaacatatgggtccatgtgttccttcactaaggtgtgatgagactcggcgcggcatatccaccaggtgatgggagcctgccgcggtgcgggcgcaagtgttgctgtctcctgaagcaggtgcacggaagcccatgtgagcagaaggccctgtgaaggaaaagtgtggttactcagacccacagctttaacacgggagtataaggttccaagttaactctgtttatttagcaccttctgtttgaacttacagggctttagatcttattaagtcctaaaaaatcaccttacagaataaaaattatagccacatcagctgagagctgaggatgcagagattaggtgaactttctacagtagtgattctcaaattttaacaccttaagaatcactcagaaggctgtaaaatgcagattaaatagaagaaataagctcccagtacagtaggaatgatttagttaataatttattgcatatttcaaaagagcttgaagagaacatttgtaatgtttccaacacaaagaaaagttacatgtttggagtgaaggatattccaattacccttatttgatcactacacactgtatacaggtatcaaaatatcacatgtacccaaaaaaagtatgactattatatattgataaaaataaataaattttaaaaatacacaaactcctgggtatgacatggctctcccccaacccacgccgagtttctaattcagtagttctggagtggggctgtacaatttgcatttcaaacatgttcctagttgataccgatgctgctggtccaagaaccacactttgaaaaacacttctttaacacacaatgcacatgactgaggtcaaaaaccctgataaactaaagtcagaaacaccagacagcagcactctaaaaggtactattaatcaaaaccagaaaagaaaagaaagtcatcatgcttgggaagagggacagggaagaaaactggataccaggcccatcagactggagcagtgctgtcaatgtttactttcaaatgctaccctcttaactgctttactcttttgtcatatagtaaacttagataacacgaaaagataggacttccaaacagaaatattctgtgtgtgtgtgtgtgtgtgtgtgtgtgtgtgtgtgtgtgtgtgtgttaataggaataggtgagactccttacagctcattgattcattgattgaagttcttctaagcatgggcaccccattggctatgggagaagcgggaatggactaaaggtactgctcttgactttggagatctcatattctagcaaatgtgtccaccctaaatcagatcatgacacatgccagacacagagagaggatggtttaattaatgctaatttgaaagaggtggtgtcagaagaggctccatggaggaggtgacatttaaatggatctagaaggatgagcagggatttaactggcagggacatttgaagaatagcatttgtctactatgtgaaaagaaaaatagttttcttttccaaggaaggaataatttttcatctcagaatcattttcatccatattgaaagaaacctattatttaatgtcagtaggcttccaaaatgaaggtaaaatatagaatagagagtagttggaataaatacatttcacaaaggcaaaatatctccctgagtagaaagcttttttttttttaatccttatctctttcctgctgacatgcctcaagggagcgttttatttaaaattgttgaatttcctgaattccactgtgtgtttcagcaaacttcttagagtcagagtgtgaaacaaagaaaatttgtactaccaaaacacccttaacattccacaggcagcttattggttggaagaattagctataggtgttaataatagtaaaatacagtaatcataatatgcattgctttataatttccactaatagatttgtattatgctgcttgggctggtataacaaaatactgtagcagagtggcttagacaatagaaatttacttctcacagttttggaggctggaagtccaagatcaacatgctggcagggttggtatctggtgagacctttcttcctggcttgcaggtggctgccttctcactgtccttatgtggcctttgcgctgtgtgcacacagagagaggaatccctgagagctcttctttttcttgtaaggacaccagtcctatcagactaaggccccatattaatgacctaattttaacctcaattaccccttacacaccatatctccaaatacagtcacatcaggggttagagctcaacacaaaaatttgggggggacataattcagtccacaataatgctgtaagtttctcaaggttagcttattttatttgtcccctgtacttcctaatccatttcctcatacacagtaggccatttgacttgaatggactcacatttactcccacagtgaattatcctagcagcaccatgagttgggcaggggagctattattatcaccccaaatttacacatgaacaatcatggatcacagtaagtatatagtatacgccaagcacttgttcaaagctctgcataaattgactatcattattcttctttcattaatgaggaaattgaagcccagagaggttaaataattgcccaagatgacatttattaaatggcaaagccagtattcaaaccctggcaggccagctccagaccccacaattttagccatgacgctatgcatcctctcctgatggccaccaaagtcctgtggcttaccaaagctttcttatttggtggctgtattagtgccctagggctgccataacaagttaccacaaacttggtggcttaaaacaatggagatttattctctcccagcgatgcaagccagaagtccaaaatcaaaggactggcagggccccatagcttccatccctggtctctttagcttctggtggctccagggagctcttggcttgtagcagcatcactccgacgtctacctccgttcatacatggccttatcctgtctctgggactctcttctgtgtaacttatgtaagaataattgtcattggatttagagcccacctagataacccaggataatctcacctgaagatttttaccttaattacatccacatagtactttttttccaaataaggtcacattcacaagttctgaaagcagaatgtggacataccttttgagataccaccatcgagcccactactgcacaaatagcaacctataatccaggaaatggagtaatatcaatacatcctctgcctggcattttttcctagaatcttatcctctttcccccttcccagactcatccacatgggtactctggttcccatcatgtaaaacatgcccaacccttagttatgagtagttgactcatggtgcatactaactcaaacttatctaagatgtaccttccctaagaagtttcagcttgagacaaagagagaaatgggacaaaagcaggtttttttatttggttggttggttgctttgttgttcttggaagccatgtttaccagcagggctgggctaggttgagctgagacaagcaagggacctagggtaccaaacttagggattggcacatgcaaggcactgagagtgacagcctcattaaatttgaggcctaaggtgtcttacttgcctcattctaatcctcctgaccttgtttcttggcatgagcagcagaggattacaggagaccctggtggcagaggcagggggacagagatatgaaagagagagagaactggtggtattctagccactggttctagttttcttgaagtttagtaagatctctgttatttggttctattacctgcttcagtatccatattaatatattcttttttctagtattattaatattattatcatgattagtttaaacttgtttgagttggttttctatcatttgcaaccaaaagaattccaaactaaagtctaggtgttttaaccccttatccttactttcccattatttcctaatatgaggagactgaagcaaagagagaaagatgatttccatgaagccatagcacctatgaaagtgcaaaccctggtctctgcatgacaacctccacgtggttaagaaggttctctcaaagacatgaaactggctcctccttgctttggtttttcataaaatttgtatattttgtcctttcagtgtgtagacaggtagaaactttaattggtgatttaagaaaatctgtatgagcatcagtgatcatactacgcacttgggtgctaatgaaatatatttggccattttaccatgcacgaagtgggccagaatgctgtgtttttattattctactgtggctgttcatggattttcttcttttctcatccgtagctttgaatatacctgctgcttctaatatgccatttttaatgttttagaaaaatcaaagggtaaataaattagcatagaccaattaacacttcatttttaagcttataaccaaaacgatataaatcccctctggaaactgttgatctcactctgacctcaaacacgtcttccttgtatcagagacagaaaagaaaatgctctaaatagagccaccataaaatcatcttccaatacaatgccttctcctcttccttctacaaaatagaacctttcgtagaaagataaaaggaattatagaatgtattcaataaggtcaattttcttctgtctcatttcctggttttcttatatgggacatggttttatttctgtctatgagcaccatcccctttgaagttatcatcatggaccacataacgacgtttccctcaatgacagaccacatatactacagtggtcccagaagattgtagtactatatttttatttttactgtaccttttctatttttagatatgtttagatacataactattaccattgtgttacaattgcctacaatattcagtacagtaacgtgctgtacaggtttgtagcctagggcaacaggctgtgccatagcctaggtttgtgttaagtacactagatgatgttcccacaacatcaaaattgcccagatgtatttgtcagagcctacccacttcattacatgatgcatgactgtaatagcaataactgccatttgctgagtacctcgtctatcacaggaattttacagtctctctcatttaaccctcacaagcctcttatttaaaaattaacagcccctttttataatgagaactactccggtttaaggagggtaagtaggttgctcaatgccgcagacctagagaatattaaagccaggatgtaggacccagcgcctgcattctttccatggtaccaggcagggtcagagtgtgtctgccctttgcaagcatttaccttttctccaagggaaagaataaaggaagtcttgggatctgctgtgttcctgggcagttcacattgactggtcatctacctgaatttatttcagagtagccaagtaatctattctactccaacacagctgagagtatcttccctgctccaaaaccaagcccagcaccaggttggttgacttctgcctgatatacattaagttgataaatttttccctgtctcttttcctgttgcagtccttagtgcatttttcttcatttgctaaacgtttaatgttctctttttcattttcaaactctttcccatacagctagtatctctttatttcccctgggctgttttatttccctacattgttcatcatatgtgataatattaacaatctgtaacggggcttcagaagactagcttctcactttggccctttccagactgatgcgactatgggcaagtcactttcactcactgagctttattgcccttgtttgttaaatggaaaattgcattttagagtctctaagatccttgccagctgatccgtctgccagtttcactacacggtgatctgcaaaaccctctctgttgtgaataaataagacaccaccacgccacctccttcattactctctttcccaaaagaaaagtctcccacaggctgtcttccaaaggtaagaggaggaattaacttattcttcatactcctggatgccttccacatcatcatttgacactcatttatttaactaacaattactgacacctaacaggtcaagcccaatgactctgtgttggcacctagagattcagatgagaaaagtgcaaaccctatcatcagagacacaaactggcacataagagaaacacagagaggagaaaatctctcatcatggcaggtgctggcactaagaacattcttccagaagtgtttatagtgaagctaagtctcaaaagctgattagtgaggtgtttaagtgcccagactctgcagtcagacagatctaagatcaatgtcacctcaaataatcactagctatatgaccttgaacaagttacttgacctttctatgcctcacttttcttcatctgtaaaatgaaaatcaaattactaaattcttaggattttggagaagagtaatatttattaactaaaaacataaagtatatactactatgctaaatcccaagaatgttgtagtaagaaacacattataaatgtatataatgatattcagtcatacatcatataatgacattttggtcaacaatgactgcatatacaaaagtagtcccataagattataatacggtatttttagtgtacctttcctatgtttagataggtttaatacacaaatacttaccactgtgttacaactgcctgcagtgttcagtatagtaacatgctgtacagatttgtaacctaagggcaatagactatgtcatatagtctaggtatatagtggggtatatataccatctaggtttgtgtaagtacactctatgacaggggtgtccagtcttttggcttccctgggcacactggaagaagaagaattgtcttgggccacacataaaatacactaacactaataatagctgataagctaaagaaaatcacaaaaaaactcacaatgttttaggaaagtttacaaatttgtgttaggccacatttaaagctgtcctgctgcatgtggcctacaaaccgcaggttggacaaacttgatctatgatatgttcgcacaatgattaaatggcctaatgatgcatttctcagagcatagccccatcattaagcaacatatgaatacatacacagacacacacattctcaaatgtgtgtgtgtgtgtgtgtgtgtgtgtgtgtatagtctcaaaaagttccaggtacgattataaacactttgtgtgtcttaattcatttaatactcactgtgaccctatgatttaagtactattattattattcccattttagagatgaagaaacaggcacaagaagaataagtgattactccaagctgccagagcctgaattctgaccaagaccgtctgtctctggagtctattctctcaactactgtgcctcctgcctctactaacctaaccacaaccctctgccaccttgatacagtcctgtgagctctgaagtgcagtaagcccttgtggagctgtcagtatagcggagaaacacaatcaaacaaaacagtaatcatgaaccgtgaaatcacttcccgggcttctgggctcctggactggtttaggacccaggcctgtccagttagattactacatcctatagagattggttcagcgatctgcacatgacctaaactgaccctagaattgttgctagaatgaatgggaaaggagagttcttttcagtagagttggctggagctgctagtgccagggccagcttgagcctgaagccaacagagaaacaggaagagccatgagaccaggagaaacagatccctggcaagaaccactcctgcatcctgagccactcaaagctctgtttgtttaagccattttggttaggtttctgtcactttcacatgactcctaacacactccggaaagtatatgtaattcactttacacagtaccactaaccacctggtagctatgtgtacagccgtttttaaagaacaagtaagagttaatcaaatatagaagcaaaaattgttctcggtagaggaacatgaatgtgcaatagcacagaggtacaagagatcattgcttattaaaggagagtgaattccagagtaatgcagctgtaacatccagacctcatcttattattgtcttcaactgacctccagataattcacctttaatgagaacttcagtaactggccaggaatttccctcttcatttctttccacaccctggaaaattttaagcatctacgcagatatattctaatttgctatttctccttcatttatagtgaattggctgaaactgccagattactgatctcaaggcattgggtctttgagatcagcaataacaccatgtttctgtaagtcttactaagcatctttaccaggctggtctagtgcatcctaggactcagcccttcctgatcaacctgtccttctgcatgtaaactattatgatgtttatttcatggtaaagaaatagagtctcagcaaggtgatgtagttgacttgaaattgcagtttggctgtggtggtgctgggacctgtcccactcccaagcctatgctttttgcattatgtggccttggttaacactttggtcctcactgaaacatgagatttggccataatactatcatccattgccattgtatgattttccagagttcctttgtatacatcctcaaactcttataaaggcttatgggactgtgccttaattccacattgaagacagtacagtatccccaccagttgcccactgggagagatgtcaatgagagaaaacgtgcaacaatcggccaaacttcccttgtcaatccctggctgattgtactggggcctctttgttggagtcactggaaatgtcacttgcaaggggcacattgtagaggccatgaatttgaaatgtagaataccaggtctctttatgctgtgtgactttcatttcgatcagactagatatctgttttgtgagctacttaggaatccatattgcctttcagttcttcattatctcattggaccactgactgaaatggcctcttcactgaccttcctgcttccactcttgctttgcacatgccccttccacactcaagtccaggagagctttctgcactatgatgaattgcacataccttcccttcaacctactaacctttcccatctaggtcagggaaaaaagaacatatgctggttatagagaagccatttgtgcctgaatctataggatgattctttctttataatataaacccaaggtatagaggagacaaagcaattcttatcaatatgtggccagaattgttatttttcaagaaattgggtcaaagtcttagtaataggataaatgatcaggcttcacggaaatgcagacttaggacataaaatctaaaatccttactaatgactgtaagcacatctttattggcctctgtaccagaggtcacatcttccaccacatcctacccctacttactggaataattattgaaattgcattgaaaccagaattcaatttggggaaaattgatatttgtaatattgactggtttaattcaagagcacaatctttccatttatttcaagtttctttaatttctctcagtaatattttgtacttttctgtgtaaagttctcaaataattcattaaatttatctctaattttttaattgtttccaatttatagaaatataattaatttttgtttatggactttgaatctcccattattgttaaattcaattattaacttcaacagtttgggctttatttctctgaaaaatgaaagttttcttttttctttttagtccttaagccttttattgactttggtctcaccttatttcattggataggaacttcagaaaatgttgaaaagtggttgaaataacaaataatcatcttgcttccaatttcaagggggaaactttcaacattccatgaataagtatgtttctaatagatacctataagtttaagtaatatccttctattcgtagttataaatctttggttttcagtttgctaagaaatttcttttttatcgtaggtagtgttgacttttccttaaccttttgagataactgtgatttttcccttttattttcttaatgcaatgattgattttcaaatgtcaaacaaacttttattcctacataaagccaacttgattgtgatgtattatccttttttatgattgggaagtctgttttctaatatttttctctacaatttctgtatctcggtttacaagagagattggcctgtaatttttctttcttgtaatatgctttattgtatcttggtttcaaggttatgctgatcactgcaaataagttaaaaccaattcccctttttctagtctctgaaaaggtttcttgtagaaatgatgttaattctgtccaaaacaccaaaagcaatggcaaccaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtaaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcgttattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccacatattctcactcataggtgggaattgaagaatgagatcacatggacacaggaaggggaatatcacactctggggactgtggtggggtgggggtagggggggagggatagcactgggagatatacctaatgctagatgacgagttagtgggtgcagcgcaccagcatggcacatgtatacatatgtaactaacctgcacaatgtgcacatgtaccctaaaacttaaagtataataaataaaatttttaaaaaaagaaaaaaatctaaaaaaaaaaagaaatgatgttaattcttttatagacttttgaaaagagttcacccataaagctatctagacatagacttttctttgtgagaagatttataatttatggattcaatttctttaacaaatacaggtaaattttatattgatttatttcattgctaatttctttaagttgtatatttaagttgtatatttcaaggaatgtatccattttgtctaaattttcaaagtttgtgcatcaagttgtttatagtagctacttacgattgctctaatgaatttatctgtagtaaagtccccttttattgttattgctgctatgcacctttctttcattctctctccttgttttataaatcctgatgaaagttaatcagttttactagttttatcaaaaaatatattttggattgtttggtgttctgtattatatagttttattttatatttcaatattttttgctgcttatacatattaattacttccttgtagctttctgaggtctgatattatgtttctatcttcttgagataaatacatagatcattagtttcagacttttttatgttgccatatgaattttaagggaatacatttaccctactagctttatctgcatcctacaagtttgacagtcatatttttactaccatttagttaaaaatattttctaattttggctgtgatttcttctttgacccacgtgtccttcaaaaaaaattcaaatatttggtaattttttttaattttttaagtttagttttcattttttgttactattgatttctagcttaattctgcttcagacagtgaatagcctatacatagtttcaagtagataaaatttgttaagatttgcttttcagcatagcatatggattaactttggtaaatgtttctgtgtacttgaaaattatgtgcagtgtatagcacatgtatacatgtagtgtatgcacatgtgtatagtacatcttctctcgtacttttacctccatagttaatgagaccttatacttaaaattagtcttttataaacagcctgcacttgaatatccatcttgagatattttcactttttattggaatattgataatgtaatttgtgcttactgatttgtgtgggttaatatctactattctacgatttatttttctttgttttttgtaatttttgttctttttctctttttattgttttctttaatttgtggaacattcttttaagtcctttttctctctatcagtgggctaagaatgaattctttcatttttctctttatggttatcccacagtttacaacacaaatccttacgggtcagagtcttctaaaagttaataatgttatcacttaacaggaaattcaaggattttagaatatttaatttaccctcatcctatcttttttgctactgttgttatgaactttaactctacatctatgttaaataaaacaaccaactgttattgctttatacaatctatatttacttaaacccactgtatatatttacgctttttgttactttttattctattttgcattttcatacttctgtcttagagcatgttcctttgcctgaataattcactttggtatttccttttggtagatttacctgcaatggctaattgcaatagatttgtttgaaaatatcttaatttcacctaaacttctggaggatattctcattgtaattacaattctacactgctaattattttcttttagcacttaaaattgttaccccatgatcttctagcttctatcaattaattctcacctgagtgatcagcatactcaacacaactttaatcaaaattccaaaagccttcttttgtaggaatcagtaagctgagcctaaaatttatgtgaaaatgcaaaggacctagaatagctaaacaactttgaaaattacaaaaaaaaaaaacaaagtttgaggacttaaaaactgtctgatttcaagactaactgggaagattcagtattccaaacagtttggtattagctaaaatatatatattatttatatatatatttatatttatatataatatataatttatatttattatatattttaatatatttagctaataaatattgtttatatgtaatttatatttattatatattataatattattttatatatttagctaatatatattatttatatatagttacatattttattgttattggtgattatatttatatacatatatatgtaacagaatagcgaatttagaagtaggtccgcacaaatgtggtcagttgatttctgacaaagatgccaagccaattaaaggtggaaatgaaagtcattcaacaaatggtgtcggatcaattagataccaatacaaaagtgaacaccagatcttacataaacaaaatgtactctaaatggatcacaaaactaaatgtaaaacctaaaacaaaacctctaaaataatgcatatgagaaaatgttttttatccttggaggttggcaaagttttcttagatagaacacaaagaacatgagccataaaggaaagaaataatatattgaacctcattaagattttaagttttgcacttaaaaatatgtcattaagaatgccaaaaggcaagtcacaaaaaaatatttccaaaatagactgggtgcagtggctcatacctgtaatcccaacattttgggaggctgaggaggccagaggatcattacagcccaggagttccagaccagctcaggcagcatagtgcaaccccatctctacaaaaaattttaaaaaattagcctggcatgctggcacacacctgtggtctgagatactcaggagggtggagggggctgaggtgggaggatagcttgagcctaggcagtcaatgctgcagtgagccatgattgtgctactctactctagtctgggtgacagagcaagactgtgcacttgaaaattatgtgtagtgtatagtatgtttatatggtacatcttctccaaacagagcgagactgttgcacatatgtatcggcaacatatatatcaaaggacttctatcacaaatatgtaacattcttacaaataagaagattaacaacccattaataaaatgggcaaagattttaaaagtcacttctaaaataaagatatagtaattgtcaaaaggcacttgaaaatatgttcaacatcattaggcataaataatattcaaattaaaaccataatgaaatatgctacaagcctattaggaagactaaaattttaaaaattaaaaatatcaagtgttgatgaggatgcagaacaggtggattctgtttcgccatttagggaatacaaaatggcactaccactttagaaaactgacagtttcttaaaaagtcatacatatacctactaaagaatccaaccattctattgctaggtatttaccacagaaaatcaaaaacacaggtcaacacaaaggttttcacacaaatgttcattttacacaaatgttcataggcaaaagttgaaatagtccaaatgtccatcaacagaggaatagataaactgtggtgtaatcatgcaaggaaacattacttaataaaaaggaatgaactattgatacatgcaacaaaatgaataaatctcaaaattgctatgctgagtaaaagaagccaggcaaaatacatactgcatttccatccatatgaaaaattataggatatccaaactaattacagtaacagaaagcaaatcagttttctggggatggggtagaggatggttggattacacagtggcataaggaactctgaggagtaacagaaatgtttgtaatctttattccggtgatgcttttacatgtatatacatacgtggaaaatgatcacattgtacactttaaatatgtacaatgtagcaaacatcaattatactgcaataatattttaattagccatccatcttattgtccatttgaaggtaatgtgtccttttttttcctctgactgctttcaagttttcccttcatcttcgtatgtagatgttcaacaattttctgtaaagtacacacaaaacatctgctacaattctttgtattgattcttcttgaggtttacagatttcttccgttactgtggcttgatgtctttttttaagttttggaaaattctaagacagtagtttttcaaacactgtttttccactgtcttctcccctccatcactcctcgtctactgtggctctaattacacatacatgagacctttcatccatgttccatattctcttgtactcttttctacattgtccatcttttctcctctctgcatttctgatattttctatgaaattatcttccagtacatttaaccttctttcctctatgtccaatctgctttaagcctagtctattaactgtttaatttcataaattacatttttcactgtagactttcttttttaacttttattttaagttcagggtacatgcgcaagatgtgcaggtttgttacataggtaaacatgtgccatggtggtttgctgcacagatcattccatcagctagatattaagcccagcgtccattagctattcttcctgatgctctccctcctcccagccccaccctctgacaggtcccagagtgtgttgtatccaccccatgtgtccatatgttctcatcattcacctctaacttataagtgagaacaggtggtatttggttttctgttcctgcattagtttgctgaggactaatccatgaggatttgtccatctctatccatgtctctgcaaaggacatgatctcattcatgtcatccatgtccaactctatccatgtccctgcaaaggacatgatcttgttcctttttatggctgcatagtattccatggtatatatgtgccacattttctttatgcagtctactattgatgcgcatttaggttttctggactttctatttgattctttttataggtttgtttccctaatgaaatattttatcttagatgtctggaggaattttatattctacaagatgcatataagaaaatacaatcaactggatgacttaagcagcaggtatttattgctcacagttatggaacctaggaagtgtaagattaatgtgccagcagatttaattccttgtgaggaccctccttctggcttgcacaccttctctctgtgtcttcacatggtcaagagaagcagcttctgcatcttataagaacaccagtcccattctggggctctactctcatgatctcatttaacctaattaccccccaatgtgattggggcttgggggacaaacaaatgaatttggaggaacacaaacatctattccttaacaatgccctttgagtttaattttactatagtcagaggtttgtttcattgctatgcacttaattcattccaagtgaaagtgaatccgaatatataaaagtaagctagctttctgattgctgattttactatgctgttctctaaaaagcttttctttaacatctttttcttctaacaaaaatgacaaaccattttgcaaacaaaaatgattttcactatttcatgtgtcctgaaatcctttgagttgcctccattttattgggtggataagcagacccatccacactttttatccagtcttttgttgaagtatactacagaaaaaatacagtctaacagttagaagatacagattcttagtcccaactctgacacttactagctttgtggtcttcataaactcatataaattctatgaatctctatcttagtgtttctcaaatgtgaaaaattgtattacttattttttcccttccgttttaacaaaggtatttttggggtacataagacaaagaatgtaaaagtgctttgtaaaatctaacatatctaaaataactattcaataaatattttgaataaataccagataatatcctatgatgtaaaaatgatataaccttaggaaaatttgggaatccagatctcaaacacagatctcttactgcaaagcctataatctcagccattacatcacaccacatctcaatgaagcaattctgtgagataggatgtaatacttttccaaatgaacgccacacagaatatctgacaattgaccccatacggaactatgatgaaaaacctaagcaaagaactaaaaatacatagtttatattaaattaactttattgataaacgatatttccttgctctttttatccaccttctttattattgcccttttttcttgctctctttaatattctagccttgcccttccaatctgaaaacatgactctggtgctttcttttctccaaatgaaactccttttcctggatataaatcacattgctttgaacacgatcagatcctttcctgaaaacatacattatatgagaggagagaaggtaattggagaaggaaaaaggtagaacctcactactgttcactattcttaagagtaaattcaggccaactcgctactgccagtcaagtcatcccatttgtagatgaagacagcctggaggaagtagacaagggtggaaagtagaggaaatgtttgcagatgtaagagacaaagttttgcacagtgatgactggtcacagaggttaaaaaccagatatccaaagtcatatttatttctgtgattcagaaatctatctgcctctagtgatttaaaacttgtgggtttgaatatgttacaggcagattgaactcacttctgcttttcacagcccccaacaaacctgactgaatttcatcaaaactacattcacccatttaccttgatcctgagacatgtgagtttgtgacgtttatgggcttaggtgaaacctgtacactttactttcttttgaagttacctcttttctaactggaataggatcatattttctgccatgaccctgttctttccaacttatagaatgtacaagtgccttgtaaagtctaacatatctagttgaatattataatacccttttgttataaaccactaaccatagataccttaccttctaaattgatctaagttgaatattaaggacaaccattatgatgtagaaactggctttgagaataaatacaaaaagcaaaagcttaattggatagtaccaattttccttgtggtccatttggtcatcatttcattctgcagccctagtgaagtggtgtgtatgttgcagttactgtatttgctatgacatcatgatgggtgcattttatatttcacagactgcataatagctattacgctttctaaacaagtatctgaaaagcccattccagtcagtttctcagatatagtaccccaaagcaaattcttttttaaaaaatggctcaaaatatgtacacatttacagtgtaatgtttacatcatttaacattgtgaacatgaagaggaaatctcctcatctgcattgactgagtgttaagcatttccaagttgagtaaaagggtatattgtgatgagaggttcacagtttagggaagtcctagacaatctcctaactttccttactgtagttgtctctgctattggaaatgaaaggaaaattcatctatgttgtgtagtcagaagtagagatgcttccatctctgtttctggttcaaagtttctgtgaaattcttagaagatcttcctgtcttcttggatataatgcactgggggatgaaaggagagaggcacggggaagtggcatacaggaaaatccatttcaccaaacacataaaaatgatctgcgtgtgagcattctaaaggaaatggaagccatatgtttctgattcatttacatgtaatccatcaaaatattattttgtaaggatagttaatgtacaagaaacctgccaagccttcttataaacatttttccaaaaatccagctgcattgatgcagctgtgtaagaagttatactggaaagatggaacttgtttcaaagtctcaagcacattttaaactccccaaggggtgcctggcatgatagcaatagcacaggctttggagttgaatagacctggatttaaaacctggattatttctttttttttttttttttttttttttttttttgagatggagtcttgctgtgtcacccaggctgagtgcagtggtgcaatctctgctcactgcaagctccacctccagagtagctgggactacaggcgcccaccaccatgcctggcttttttgtttgtttgtttgttttgtattttttagtagaggcaaggtttcaccatgttagccaggatggtctcgatctcctgacctcgtgatctgcccacctcggcctcccagagtgttgggattacaggcatgcgccaccgtgcctggccaaaacctggattatttctcattaacctttttcataaaaaaaatatttcttggccaggcactgtggcttacacctgtaatcccagcattttgggaggctgaggcaggcgaatcacgaggtcaggagttcgagaccagcctggccaatatggtgaaaccccatctctactaaaaatacgaaaattagccaggcatggtggcgtgcacctgtagtcccagttactcgggaggctgaggcaggagaatcacttgaacctgggaggcagaggttgcagtgagtggagattgcaccactgactccagcctgggcaatagagcgagactctgtctctaaatagatagatagataaataaataaataaataaatatctcatatatatatatatatatatatatatttctctatatttatttgtttgtttagtgtctaatttgtgccaggcagaagatgtgatactgaattagggatacagtagtggacaaatagaataaactagatccctcttttcattaatctagttactcaatttatctgagcttgtattttcttattctgagaaatggagatgataatgctcatccttaaaagtcttcaccattcagtaagtaacccaactcctggcatgaaaaatacactcaatgaaaggagttattttccattttcaacctttttctatttgaagccactttcccacttcaatctgtctgcacatacacccttacagacggtccctgctcctctagcacccacaaagaccacaatcattggaatgcttcacatttgtttgtctcattgtccactaggtcaaagggccactttctctgaaatgcatagcaatacatgttagactggaagaactaaataacaatttgccttgggaatacacggggaacgcatatactttggagtcaggacaaactggacttaaattttctattttccattcataatcttttttatcttggtcacatttctgagctttggtttctacatcagtaaaatgggattaaaattacctaatgtgcagtgttgctgggactaattcaataggataatacatggaaggtgtctagcccaataatggcagatcttattacttccatagagagtaaatcaaaatgttttatttcaagggtttaatgtccaaaaccataatattgcaaccatcttggtagatcataacctgtttaacacttgaactgtaggcaacctgaaaaactcatcaactccacccactgaacacattttttttttaatactttaagtattagggtacatgtgaacaacatgcaggttggttacatatgtatacgtgtgccatgttggtgtgctgcacccattaactcgtcatttaacatcaggtatatctcctaatgctatccttcccccgtccccccaccccacaacaggccccggtgtgtgatgttccccttcctgtgtccacatgttctcattgttcagttcccacctatgagtgagaacatgcggtgttcggttttttgtccttgagatagtttgctgagaatgatggtttccagcttcatccatgtccctacaaaggacatgaactcatccttttttatggctgcatagtattccatggtgtatatgtgccacattttcttaatccagtctatcactgttggacatttgggttggttccaagtctttgctattgtgaatagtgctgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaattagtttacagtcccaccaatcagtgtaaaagtgttcctatttctccacatcctctccagcacgtatgtatagctattaagtctcttgaagatgcccaaggttaaattttttttagcaagaatgcaataatcacttgacatgtggtttgctattctccattaatattttcattgcagacattactaatcaatcacaaaaaacttttccactgaacatatacagcctcaaaattcttttctcagcatttgatgcagccactaccaatcatatagagctggcaagtaatgtacccctatctgtatacttgatttaatacatcaaataggttgcatgatccactcttttgaaatatcaagtctatttaacagacatttatttagcacttactgtgtgtctggtcatggagttatagagacaagtaaactatcactctatcagatgtactacaagtccaaatgaataattgctaaatagggatatgaattacaacagagaagtgttgttgaattaaaagaaaggaggatttgtttttgtcctacttgttagctcctctattcgaagtgacaagaatacaactagcaaattgtaaagctcaaaaactattaattgaatgagtgagaatgtatgtggttagcacctactttgtgcctcctgtatctactctgttcatttgatatggttttcctttcaagaatgatgcacagtaggtggaaaagttggggggtatcaaaaggaggatcagcacaaatgctgataagaccttatcaaaggataagaccatttctgccagagagaagaaggaagagattcatgcttaggcagaagaagtgacctaagcaaatacaaagtatgaaagttcacagcctaacagtgctttatatttttgcagatttggaatatatgtctagccagatcacctcctaagcttggacaaccagataagaaacaatgcctgtggccaagtggaacagagttacgtcaaagaaagtgatgaaagatgccaaggagagaagctgttcttcgttgtttttggactttactaatgctatttttcccggcagtcaccgctgcttgcctgatcattagcacccaaacatcttgtttgtttctaccagacggaagtaatatacaattatgcaaattatcttaactccaagtaaggaatcacaggccagtcaataatgttgatgtattatgaaagggcagctcctcctggaagaaataacatgaagagctgatcataagcaaacattttgaagcctgcagaggactggtccctgcagcgcaatctattatcatatttccacataattagtttgttttccacttgaaatcaaaaaacgattcgacattgccttccctgcctcaggatggaagagcttccagtggaattctcctgcgaaggttcatatggtgaataattagtgagaattaatctgtggaaattaaagtttggaatattgtagaactcatgaatagtgcatggggcaattgggtggaggaagagaagagcagcacttcatggtagacaatcacagatgactgctggcaatccgttttttaatcagtgctgtgcgagccagggggttggatatggctacagtctgtggagaaatactgtcaaatttttacaggcaggacaaggaaacatttccagagatgcctatctctaagctcattttggtagtttttacttggaagagatgccctggaatcagagggattttctccaactgatgctgatggcattaactactttcatccttgcaactgcacggattttattacctttgtctttgattttcttgtccccattttactgatgagaaaactggagtcaccagcttctaagtgatccttctgacgcactgagatcagaaggcaagtcttcctgattacaaaagccaatagctaaagcgtaaaattctagcatgagctggaatcagagtggtggagtttcaaatttttaatccatctaagtatcagtttcctcaactgaaaagtgatgacattacatattttataaagttttatgagggctacatgaaatagtacaaacaaagccttcacataggatctgcacataataaagacacactatatttacatgaaaaaattaatataaatccattctcccagattactctgacactcaaatatataagcgtcttattatgctttggaaataattccctcaaatgatttcaggatcaagttataacttcctttctcctacatccctatggtggcagttttcccaagcatctgtttacctaaaaataaatttaaatggaaaatttgcaagtgatcagggttaatgtctccaattattaagtgactggaaaaatggtacagcaggaacacacagcaggggagcattttttagatgtagaacgcaaagaattttttgtagattatagaatggttttattttccaaggctgtagctcacttgagcaatagttgcctgtgattactagaacaatatggtcaccagagctcaaaatacagtaagaataaaagaaacagagcacatgtccaaagaaacaaacagtttatttttccccaattataaatgtaaaacttgatatagaagaaaagtacgtgaaagtaaaagaaaaagctcaccataaccttaaagatctttcccgttaaagtttttgacattttgtgtgttttctgccaattttttttttctgggcataattttccataattgttgtcatactgcatctgcaatttaaattttccctttcacttaaaatagtaagataagcatttttacaaaggttctaataacatgagcattttttaaaaataaggcacaatcaatataaagaatgatagttgctcttaaaacaaggaattgttttcagattcaaggatcaccttttgtttctttctcagagagagtggtttccaatccaaatgcacatttgcctctcaggcatctgttggatttggaagaggttcccagattgagttgagaaatggtcattacagttaagctgcaacttcaatcttcaaaatgaatgaatggatccagtccagtcctttggctgggacccagtctttaaaatccagcagaacaatgaatatgtggcttcacagccagctggtatcagacttgggcagggagagtgtcaaaatattagtgacttttttacatttgtcaaagctgaggccaatacaagaaatgcagacagcttgcaaatgtgggttgtgcaccaaagggtttttgtgtgtgtgtttttttcaatcctgcccaccggatgtcaacatttccttgctttctgattatttctgcagcaaagacagagtgaaatatcttttactttgaatatgaaaactgctatagatttatcatcaacacatcaaccactaatttattatactggggcaatgtactcaactggaataaaggggccatcagcatttccatggcaattcttccttttctttccttggtttataactcatctgcttactcagttgttcctgaacctggcaggcaaggtctcagtgggagaataaatatatttatacaaaatgtttaagaaaggctgcccacattgagttagaaaaataagcatatgctagtgctgtctggcactctctttgcaattcctgtatctttccaaaaggaaaaaaaaaatctacaacagaacattttattttatttttaaaagaaacattgttggcagccaacgtgcaatatgggcttgatgggattttttttctcctctttatcttttcctttgcctttttcaaaaaaactatatggaacaacaagctaattgcttccagagtaaaataaatcaattattaacaggcaaatgtagctgagttatctctttgcccatctcttttccatattccttggatgaaagtagatgatttcatgcacatgacaattcagggttgtatgcacctggtgagagaaagagtatggggcacccctgtgtctggtatctaggattcatttaaacaatgtttcatcccttccccatttttgctgcatcaaataaatgaagaagtcagagcctatagagctactaacaatgacaacaaaaaaatgcataatatttccacaatatttatagcttatgaggtgcttgcatagtcattaggtcattcaagaatcaccgtatcctagtgagctagttattattataattattctcattttgctgatgagaaaactgaaggtctgaaaagttaagtaatttttccaaagatacagcattttgaatgactgaccagacacaagaaaagcaatgatggtgttgatatttgataatattgaactttacctgagccctgtgctcctggaaaacagcaaaagttaagacattcccttatcctaatatgtaccccaagaatagcttactgcaaagaactactcttctgcacataacttaaaaaagacctgtgaatgactccttttttgcctttgacaaggctggacacagatcctccaaattcccaccctttgcctcataaatgattagcttaactgtttctttccactcaccaacctggacaaaatgcctaccaatttgatttgcttaaactatactcaagtgtctcacctctccccaggtctcttatctttgatcctctgctgagcaatggaacttggagcaacctctccttactgtcccctcctgaaaatcagctgaaatggggagacaggggaagggatatcaactgtctcatcatgccactcacttacccactttccacgccccatacctgttctttctagccttgtttattccttgccataaagaacaaaaaaagctgtcctctgcctgacatttgagatggagatcttagggtcattaatctattgcaattgtctaccttttctattgcaatattttaaaaataaaatctccatttacttaagtccagatttgtttttatttgatatgttagcaataatgattgttaacatatgtgtagtcctcagaattaataagcattttgaaaagaatcataacctctatttgtatagtgctaaatgcttccccattaattataatttcaaaatgactctttatcatccagaggacaattaatacccctttctaaaaataaagtcactgatgatgagaaataaagtgacttatccaaagtcacagagtctagggaattgaagtaaaatggacaattctgaccaaggacataagccttcttcttcctggtttactattctttcactcaccacatgaacataagccaggccaggtttatactcacttgaaaaaggtcagtcttttgtagattgacaatacagacaatgaagcttactctgtgggctctttgcttacacaggcccctttcaaaacctaaattttgattaacacagtaatttttttcttagtcacccatcaactgtataatcttcaagtgccacaaaacctggatctactcctgagaataatgccaatatgttgtgtttttagaagcatactcacatggctctactcacaaaaatcactttttccagatagtgcaatgccaaaattttcacaaagacagttttttattgactgtttctcaacatttgttctgtgtcatgctaaatttattagatattagcagatgatccacaaaaagagaattggcagtcaaaccaaagagtatcaataagcaaaggctttttaaaaatctgtaggactccttggttcttttaatatgttaaccagtatagtgattctcaagaattatttttaaagagaccatcttcttgtactaaccttcccaaaagcaaacttaagaaatgctggattaaggaattgagtctctaaggaacctctgtttaaaaggaaatacacaatatagagccataaaataagctaataaaagcctttttaactttagggtaagtcaatctatcaggcaaattctaggttcttagcaagaatctaatgcaaaagaagagcagagaaagatccattttgataagtagccaataaggagtttggacccagatgatgccttcatgagcaggccaggtaaagcccccagtgtgtggaagcattttgtctagaataaaaaacaagcccaagaagacacagggcacttgaaaaatagaagccctccaaaaaaaaaagaggtgacagttcagcaggcatggatttttcccacttgaagggcaccaactagtacataagcaaaattttttagagaaaatacagtttttttcaacttctattttcgaatcggagggtgcatgtgtagatttgttataaaggtatactgagtgatgttgaggtttggagtacaaatgaatccatcacccaggtaataaaatgtgtcatttttcaacccttgccctcctccctctctcccctctctaattgtccgcagtgtctgctgttcccatctgtatgtccacgtgtaccatcgttttgctcccacttattagggagaacaaagggtatttggttttctgtttctgcgttagttcactcagagtaatggcctccagctgcatccatgttgctgcaaaagccacgattttgttcttctttatgtctgcatagtattccatgatatacatgtaccacattttctttatccaatccacagttgatgggaaactgagttgattccatggctttgctattgtgttgttttaaaaattatcatttgcttctttataaagcagctgtagtttgggaaaagagcacctgatataaagtccaacaggtaggatttttaataccagctcttctacttctagatgtatgaaatggaacaaggctctttatcttcattagcctcaatttctccatttgattgaagagacaatagtatttaactcaacagatgtttttaattcagtgggatgcttcctgagaaagagcaaagttcagaaactaacatatgatagagcactaaaaatatatgtgttgggtctgaactacaactctgggaggtagatattttattacttccattccatagaagaggaaagagaggctcagaaaagtaatgttgaattctttgttcgacatttttcagctagaaagcagaagagaagaggctcaaatcctgactactgattttgaatcttctcttctttccacatgccatgtgcttctttttgtaagtttgccttgggtcactcctaaagaaagaatcatgaaataactaaaaggtgcctgaagatgtggtttggatcccttcagagaaaggatcaaaactggtcattcagcaggtgagaagcctacaaggtaaagcccccactcctaacaccttagcggcagacaccccgtagtctggctactacctgcttctctatgtgcttacctaccacttcatcatcttgttatttgagctccaatcatactacacttgtgcttcccagaatatacctgctcttttgcattccacttggcttgttcatgctgcctaaacctgactttcttctccctaccatttctcaccaaggtaattattacttttctgtcatgactcagtttagctgatgcctcctgcaagcttcctctgacattcctagaccaggtttaaggaactccctctttgttgacatagcaacctgcccaaacctctactatggtactgaacacactgaagtacaggttttggtttgtatgtctccccatctacatagctgtttcttatggaaatgttgctgcaagaaacagaagcctatcgaattctcttaagacctcactgaaatctaaaagcaaaaatgaacaatcaggtctcaagaaggtcaaaaataaagccttcccagagacctgagcaacacagatggacatctgtgttctaccatttacacaactcaggggccaactcccttaccctttattcctttaattcgaacttctgagaaatataaactaactgcactgggccagatgtctaactatgaaccaacagctgtgtccagaagaggggatagactattatgaacatggacatctgacccatgcccttattaagaatgtggggcatttctgtgaagtagtgtgcaggcggaacagggcctctgatcatgtaacctagaattggagaactgaagaatagggacaatctcttagccatctctatattcccattggctagcacagtgagagaacatcataggcaccctgaaaatataaataatgggagtgatgacttttatcatttagagagccagcagcactccatgagtccagctcccttctctccaaatagatgagaccttgagttaggagagattaatttcatttggccatcaggcaggagtgctcacttggcaatttttaaatgcaaatccaattgtggattgctcacaaagtaattctgcttattttctcctttttttttttgaaagaattgactaggatgcaaatgcaattacaagggataatgaccgccaccagttatattaaaacgtcagatataaagtacaagtaattacctgcccttcaagaaaatcttgatgtatggacccccaaagtcattatacagtccattcatcaacatttattcaatacccaccatgtatacaatattgtactaaatgcataggaagcttgcaaaggaaagtgaaaaccagcttctcctcttagaaagtatagaaagttctgctctggaataggttgtttgtgaccagggaacagattatagttaaccaattcacactgtagtcacatagtatactttggtaaatgtttgaaagggtagggagatttagcttgaagaataaaacattaaagagaaaagcagtattcattcaacaaatacttattaagcaagaattatgcaccactcattgttctaggtacttggtgtattcctgtggcccttgtattcttttgcagaaaggcagataataaacaatcaaataaacatgataatttcataataatatttatagtgataagagctacatggaaactcgaagaagatgctgcaataaaaccaacatattgctttaaagtataagtcctcacttaacattgttgataggttcttggaaactgcaatgttaagtgaaatgatgtactgtatgccataggaatctaactctttgtaaaactggttttgttatacagtacattgtctcacttaaaatcacagtttccaagaacactactgacgatgttaagcgaggatttactgtagctgctttagatagggtagtcagcgatggatgctccgagctgactcccgcataaggaggaaccagccatgaagaagtttctaggctcaacagcaagtgcaaagtccccagtaagtgaatgagcttagttttcaaggatcagaaaaaagacacatgcagctaggatgaattactgagtagaaaagtgataaagatggattcacaaaattaggcaatcatcagcccgtgtagtttgcagaacacagtaagaagtttgtattgtttcttaaatgtaatgaaacatcattgaagggctttaagtaacaaaatgacttgacataattttaggaagatcactatgactatcttggggagaatagattgtggattgtaaggattcaaaaatccaagcaaggacaagatctggatgtctcataatagtccaggagagacataatggtgtcttgacctagggtggtgatggggagaggttgacagaatcaggatatatttcagacttacatgtggataggatatgatgggaggagaaaaaaatcatggaaacattttagaatatgaacttaaataactgaatagggagtggcgccatcaatgacaatggagatgattttggtgggggaatcaaaaatttgtgttgaggcaggaaaagtttgagatgccaagtggaaacgccaagtgacagctcagataaaagccaaggtcaagttattgacatgtagatgtatgtaaagccacgaaaatgataattatcttcaaatgcttgctgcaaaaggaattagatatatttgtagttgcttgtggcaatgatacccagacattggttgcttgataaagcattttgaaattttagatgtcctggtttcattccaagcttttatgactcagtagatttgggatttttattcatggttcagtaagtggtgtgtgtgtgtgtgtgtgtgagagagagagagagacagtgagagagagagacagtgagagagagagacagtgagagagagagagagagagaatcactgttttacagggaagattcaggataagtgaataaagttaatatcctctgaccctttggtgagaattgcaggagcaattttagaatccctgcattaatagcagagagcttgaactaaaatacactttggataccatttctttgtcttggttctccagcttaaaacactattttggcaattactctgcaacttattctatagcatgcatggccacccccagatactctgtatcccttttgtacaccttttccataggtaacatgatagatttatgcaagagtcctaatgcggagttagcaaactctgtcgaaaggatcagagagtaaatattttaggctttatgggatatatggtcttgtcacaactattcaactgtgctctcgtagtggagaaaaaaggcaataagtaaatgaatgagcatggctatgttccaataaaactttatttaaaagatcaggcatggacaaagatttgacctgtaggccatagttgccaaccccagatctaatgtatggtgctgggtatgagaaaagtgcctagcggtagcccttatgtacagatgatctctaaagcctggatttagttggagcactttgccaatgttcttgaacaagtactatattttatatgattttgacaacacaaaataagaaagcaggattagataggcaagttcaaattgaggataaaagctgatattgctctttctgcatattatgagctgtggattagcactgtattagaaaaaagtttgaaactgggaggtgatgtactacttagacatgctgctccttagttatgtggctcaggcaagctacttatcttttttaagtccaagtattttttttccattaagtctacataataatataacatatcttactggcttcttgtgatgataaatgatacaataagtgaaagacacaacatagtccctaacagagcaaatactctaaagtcataattagatgcagatacaattgtacacttaaatatggaaggacataattattggtatatgaagggacataggaataaatatagacatggatgaatggtgaaatcataagctagctcctggtcactgcaagtgttcaagtggagactgaagagtcattatttacaaaagaacaagttgtaccaggaaatgctctgagtttctaattttaaatttgcaacgtaatgacagagtcaggatgcttacccactgttggatactttcaattaagttttcatgtcagggctaggttggatattttgcatcatatggaggcaacactctgcaggaagaagcatggacttcagcatcaaacacacatgagcttgaactttcagctctactattctactatctgttggcattaagcctgttgattcacctattttaattattcaaacggggtcaatatccctaaaaggactaaattaggtaataaagtaactggcacatagtagataatgacactttccttcccagcattttttttttttattctgaataccccctgtacactctaaataaggttctcaccttaggttttcctcttcatccttccattttcttcatcaggagcaaaattaagtttctatcaagtgctcactgacattaccctggcatctgaactatccaatgtgacatacacaaaactttaatgtgtagacatgctaatcagaagggaaatgtcaaatctgcatacatttcaaatgacccaacaatatttaccttagagctacgtctcctatttttctgacaattgcctcattgaggaagtgactcatgcagcataccaagccccattccatctgagaactttacctccgactggtttgaaagcatcaaaaagatgaatgtcactgccttgcagttagtaaggaggctaatttgatttgacaaatgatgctgattttgaaggggtcactaatcattagaactaccgaggacaaagagtgccttgaagctggataaaaattgaatatttaaacagtttgttatgcaaatttactttctacctgtcaggagtgtgtaaagcacagggttagagagtttgtggtaaggccatccctaggctgatgacttctctgcacagtctgtcctcaccacccagaggtctagtggcccaaagcccttggatctgcaactcctgctcacccaggtggagggtgaggtgagcacagctccacaaggagttcagagcctccacttctcaatctctcactatcccttctccatggccatcaaaaaaatgaagagtgagctgagttaaaatccagttcacccgaaatgccaacttccagattagcaaataacccctcatggccccaaaagagagaaatccggagctttatgaaggctacactgacattctcaaggaacctcagcattttgaagcaacagggcctccttcttgtctctagtatctacagaaaagcctttgtctccatagctactcattctccattttaattagaggctttattttgttttgtttgttttgttttgaagttttattataagttcaggggtacatgtgcaggtttgttttataggtaaacttgcatcatgggggtttgttgtacagattatttcattaccgagatattaagcctagtactcattagttatttttccttatcctcttcctcctcccaccctccatcctcaggtaggcctcagtgtgtgtcgtttccctctatatgtccatgtgttctcatcatttagctcctacttataattgagaacatgtggtatttggttttctgttttgcattagtttgctgaagataatggcctccagctccattcatgtctctgcaaaggacatgaactcatttttttttaatggctgcatagtgttccattaacatcctcattccaactgatcattagagaaattcaaatcaaaaccaaaatgagacaccatctcacatcagtcagaatggctattattaaaaagtcaaaaaataactgatgctggtaaggttgtggagaaagaggaatgtttatacactgttggtaggagtgtaaattactttaagcattttagaagacagtgtggtaattcctcaaagacctaaaaacagaaatgccatttgacccagcaatcccattactgggtatatacccaaaggaatacaaattattctattacaaagactcatgaatgcgtatattcattgcaacactattcacaatagcaaaagcagggaatcaacctacatgcccatcagtgatagactggataaagaaaatgtggtttcttttgtttttaatcaaaagtatcctcaaggatatttgcttcctcacatatgccccacacagtgactgcccctttgtactcactcactgagaaagtcctttgtcttttttggtcacactgcagccctctgtccactctgtactctgtgtgacgtgagggcaacattcagccccttttcatttaggttttctcaaacattgccatgaaaatgaaaggtttgaccccaaagcccaaacttaggtttcctgacattgggcaatattcctgtaacattgccttgagcatttccatatctgtagtagggcagaggtaacacatgttaatctcacttcccatattgtgtttcctacactcaatttatgatcattgaactggttgtggagggccttctgagccattgtgagaaatggagcactaccctgagtgagataggaagccaagggagagttctgagcagtttcttattttaaagcttgtggacaacactatttcttcagagggccattgtgaaataatgtatgtaaaacacatagcacaaggcctgttacataattagtacacaataactgtgcgctgctgcctttatgaacattaaattcatagccgctttaccttggcctttttattttattttactttttcttttggtgtaagggagggtacattataaattgaacaaatgtccttgctcttgtaagactgatatatatttctgaatagtctgacaaaaatctaacagttctagactacacatgcttttagcaactgaaccaaagccagattcttgtttttaatatcttcactctgggagctaaaagaacatcttgtgactaaagggaagttaaagcccagtatgattggcctttgcccgttaattcaattaataaatgtatatggaacacacctataaggtacaatggctttgaaaccaaaagtcctgttcaaacgtcagcactgctttttatgttattgtgtctgcgaacttgtcactagatttctccaagtctgtttcctcaccttcaaaatgggaacactttaaaagaggcttcgttgtaggaatttaaaagacaaaagaatatagtatctctcagtgggcaagatcaaagatcatagaataataataatttttaaagtgtgcccatcatgtaggtatctctaaatgaacaaataaaataatttgaatcaaagttatgctaccctaaaaattttaattttgacaattcaacatctattagtataataaccctgctaatccttgcagaggatataaacttaaataatgtctggcttagctagggcatttcagggcatggtcgcagctcagcaaagcatgctgtgtaatacatcaagaggtaactctaggttacgacctcaggtctcatggagctggtatctaaaccaatccatcccacaagcccatattttactattgctaatccttacaactattatataaagtaatatcattatctctattttacacgtgagaaaactgaggtatactaaggtgaactcatttttcccatgttttccagttggaaagtggtagggctaagtgctcatttcatttaatttcaacaaggatttgtacagtacctactctgatactgtcctagatgctctagttataacagtgaaggaaaaatcaccaagcttttgtcgaagatttcagcccagatctgacctactccaaaagctgaatctttccaccaagcccactgcttcattgcattggtgctatatggagagataaacctgaccccaattcagtaagttacgatgttcccattatgccatttttattccctttatgatttaatcagaacacttgcttaaattaaaatatagcttagtcatgcatctgatcttctttcccctaacatttttttcatggagctgtcagttttgcaaactggcttgatttacagatattttatccagaaataaattgaattaacaatttaaaatgcagaacagaaaaggctgccagtgtgctaatagctccatttccctgattaagaaggctttctctaagatggtatgaaggacagagccctctttggcctaaaactcattttgacaacggtcttggaataaatagattctagaagaacactgccttgtctcaggaacagacatccaccccagatcctgtggccaaactaaccttcaaaaatattaccttgtacgtttactttggtcataagcttttggggttttctacacttacagagagaaaagaaaaaaaccctaagattgccattcaaagtcaccaatttttctctaacttctttagtcttattccctccctcctcctgccacctccctgagtcctcaggagcagcagattggagtttgatgccccactctgttacagattagaggcgctaccttagccaagtcactttacctctcagagtttcagttccatctttattctttaaaaggagacagtaaaatttgttctctgctcctcttagatctgaggagaggctccaatgaggcaaaaggttttgtaaattgtacaatggataagccaccttacaggatctgcaccacccataattatctatgcttttttccatacacatttctcttccaaggcatttctccctttctgcaacgcacatgctccctcttcccccatctatacaaataagagcttgtctttcttcagggcccagcttgagcctgacctcctaaaagaagtcagttgtcctaactgtcctagccctcaagaatctcctcccccagtgacttgtcatggtttctctcatttggcacttggccttggctgcctttatgtcctcattccttagtatctcaacagttagcttgtaaacccctataagtgagtctcttagtacattttgggctgctatgacagagtactcaaatctgggtaattgataaagagcagatttttatttccctatagttctagagtttgggaagcccaggatgaaagtgccagcatctgggcagggccttgttgctgtttcctcatatattggaaagctgaagggcaagagagtgtgtgcccactcccacaagccctttttatagcagcgttaatccattcttgagggctcgacctaaacacctccccaaacacttcccaacactgtttcactggggattaagtttccaatacaggaattttagggggcacattcagaccacaacaaggagagatttcattttacactaatttatattaatatataacactaagattcacattcagctagcacttactgaatgcccactgtgtgcctactctgtgtcaagggcaattatagatgcattctcatttgctgtctcctgtacctctcataagaaactcattactaattcttcacattttacacaaatagagacagaggttcagaggagttaactcttcattgttcagtatctcacaggtagtaagtggcaggactgaaaacttatttcaggacagatttcaaagcccatgttctttccaccaaattatgccatcttttttattaagtgtcgactgatcctaattgtatgatggtaggtaactggggcatcaaatggggtctctagtagctcagagcactaaccatctggacctgattataattgaccatacggattcatatctgactattcatcctataaatatatttctctacggcttttattttttacatagttaagcacataaaaagcaagaaacacaatgtagaataaaatgtataattcaaaccttaaattcccttcttatcatcagtataattttggttacttttacatccttgtgtcccagttccctcaaatgaaaaatgagaataccattaccaaccttacggggtagtgtgaggattaattgagatgtataaactgaaatatacagttgttataaaaattgtgggaaatgcataggaatcatgtccagtaatagctccctaattctaactttgtgcttgtgccaatatcaggtgaatattccttgtaaaatctctgaatagaaaatattctaggcaataagagggcacagaaatttttatagagacaaaaatggtaagaactacttatgaaaaaccaaactcttagaagaaatctgtaaagatttgtaaaaaacttgtattctattctgctttctgttactagaagatttacaatataggtttatatgttgtctaggaggctatagaggccattcttcaataggtcaaatttacttacatatttaacattactaagtacacatgactaagtatgccattggccgaaaggggtggaagagacaggggaaggagaagtcacaaagataagtgatatcttctctctgccatcaaaataactcatattttaatgatgtggccagccacgtagagtacttagaaaggaaaggagtcctgtggacttggagaggaagaaactttccacttataaacacaacatggggccagcatcaggaagaaatgtttccattacaacacctggttaaattgctctacaatttcatgtttatctgcttcaattttttaacaatttatatcaaactcccatagagataactcataggagcagagtaaatccagttccaatagaaatacagagaccagacttgtctacttgacttccgtattagtctgttagggctgctataacagaattccactgactgagtggcttaaacaataggaatttattttctcacagttctgaagcttggaagtccgagatcaaggtgtcggtggggttggtttctggggaggcctctctccatggcttgtgtgtgatggccttctctctgtcttcacatcatagcctttcctctgtgggctcacatgcctggtgcctggtgcctctttctcttctcataaggacaccagtcctattaaattagagtcccaaccctgtgacctcatttaatgtcaattactccttaaaggccctagctccaaatacagtcacattggaagtttgggtctcaacatatgaatttggaggggacacagttcagtccaggagagcctcctcgttacctctcacatggtctgtaaggtgtttttcagaatccctaagaatctactaggggaaaaaaaaaaaaaacatgaaaattgctagtccatatcattagtaataactttctcaaatcatatcaaatctcataatggaatgaccattgtttctcattgtttgcattgtttctcattgtttgcattgtttgcatttctttcttcttacttaatctaagtcagaaatgaagacagagaagttaggtcatatgaaattggatcagtaagagatcgttggcttaacaaaatgtacccactttgaagaacattttctctggacttggctggactgactaggtcctcacagcttttagactctatgatgttgagcttttccacactgtctgcaacaccccaaaaatgtccagtgtacatagagacaggtgcaaatgagctcatttcaccttcctttctaggagtttaggtcaaacttctttattggctggaaagaaacatcttttttgacttacccttagcatcatccactaaaataagacattacagaaaaaagatgctcagtcttggtgaaatgtccattttcaagtatacatacaccttcacaagatctctctctttcagtctctctccacaccccctccactgtctgtctgtctctctctctctctctctcacacacacacacacacacacacagctagagtctaaggcaatattcaacacatttaggaaaaaaactgtctaataaggaactctctaaggagattacttagctagtttttacctactctggccatgataattttgactattcagttagtctctaactatacaaaataatacttgaaaattgtttttcccagaatttaccaaaataataatatgatttgttatagaaatgagagtggggtggggggtactccaggcagaaggcacaacgtaaacaaaggtgaggaaacaggaaacataggatgtacacaaagaacaagttttaactttgacagaaagaattgaggatgacaaaagggcaataatgatttttttaaaatttgctttgaaagaatgaatagagtcagatcattaggggcctagaggctaagataggcagtttgactaattttttctaagcgccagagaatgatgaaatgttttcagcaaaagcagtatgcctggaactctgctataggaaaattaacacagtgggtatgtgtggcattaatcaaagaaggaagaaaaagttgaggaaatcacctagaactctaatggaaaatgtgacataacagttagaaaagcaggaagcagcaaagtgtcagtggaaccacaacactgtgaattttaactttatcattttccacctatttattagagacctgcaaggtctctagcacaaagcagtttatcattttgttgagaaatgaatctgaatcatgtactctgtaagacagatgtatagaaatgaactctgcaatctgttaagtgagcctagctaaatgcccaataaccatagcttaatacaatgtactccacatcctcacatacacagaggcagtaggagttagtagacaaatcttgactcaggaactatgcaaaacaaaaacacaatgactcccactcagctgtgctagggacgtcaggggctgatatgaacaaaataaatatcccacgatcagacagcttcacacaaaggcaaaagagctgattgctgccaccaggtgattcaagaagttccaaagcacaccattctaaaaatctttttctggccgggcgcagtgtctcacgcctgtaatcctaacactttgagaggctgaggcaggcggatcacaaggtcaggagatcaagatcatgctggctaacacagtgaaaccctgtctctactaaaaatacaaaaaattagccaggtgtggtagtgggcgcctgtaatcccagctactcgggaagctgaggcaggagaatggcatgaacctgggtggtggagcttgcagtgagccgagatagcgccactgcacttcagcttgggcgacagagcaagactccacctcaaaaaaaaaaaaattttttttcctaacagcctgcatgaaaatgtcacattaaactccttaagggaaggcccttgtgaaaatccaaatccataccactatttataaatgacacactatttataaatgacactaacaggatagggctgcacctacgcaacattttgctcaagatggcctgtggcacatcagggaaagtaatcccaactaagctaggagagggttcatagtcacatcaagaaatggtcagttacacacttaaagatggggattatatttgaatgtactgtccagtgtagcttggaaaaagtgaatttttttcaaataccacaaatgatgttagtatatcagagactcatttccatgtctgttgatctctctttttccattccttaactgtcagcctttcatgtctatgtactttggatggcccttgtaaactgtatttatcttaggtttgtatacatagccaccctcataatctttgtctttcaaaaggggagtttagtttatttacatttaccataacaattatttatttcaatttattactatgatgttattgtgtactttctgtttggcagggcttttctatgcttcttttaatttttttcctgcctacttttacactgattatttctctcattcagatttttctctctatactctatacatttcgttttttagtttttactctagaaatgtaacatgcatacttagttttccaaagtcctaattttatcgataactttatgcttcttcctatcactactcaccaaatttatatagagtatttgccatgtgttttcattttccactgttttattttaactctgctaaaatatttttgttttacactatcaatgtttattttgttatcaattattattgtcacttatcatttcatcttataactcaacctttgattaaaggtaacttctgtcagccgggcatggtggctcatgcctgtaagcccagcactttgggaggccgaggcaggtggatcacaaggtcaggagatcaaaaccatactggctaacacagtgaaaccccatctctactaaaaaacaaaaaattagccaagcacggtggcgggcgcctgtaatcccagctactcgggaggctgaggcaggagaatggcatgaacctgggaggcggagcttgcagtgagtcgagatggtgccactgcactccagcctgggcgacagagcaagactccacctcaaaaaaaaaaaaaaaaaaaaagataacttccgtttccttgaagtttggaatttcctgtaataaggatctcttggttaagattttgtttgaagataactatacttagcatttattgttgaaagatattttcattggttatacacttctgagttgataagtattttccctcagtatatgaaaaatgtcgtcccactgtcctccgccttccattgttgctattcggaagtcagctgagtgacttactagtattcttttgtaggtagtctgttttcctctggctgttttaaatatattttctgactctttaatgctctggaattttactagaatatgaattttactccagttttggcagtatggatgtaggtgtagatttattttcatttatcctgtttgaaattaattaggcttcctgaatgtgataatttttgtcttctttaagttcttgaaaatttccagccaaaatttctttaaacattttctttcctcattctctcttctcttcttctctgaccaaatatttgttatatctcactctagccatgtcttttctcctcttatctacattttttcatcttttagtttccctatgctgcttcagattcagatatatagtttagtttaattctctcctcagctatatctaatgtgctataaaattgtcattgaatctttattgtaaatgttattttccatgtttatacatttcttgggttctttttcaaatttgcttggtcatttttatagtctgttcataattaatattttaatatcctcccttatttaagcttattttagtaaattggattgctgttcatgaaatattcattctcctctttcccgaaacatgcaggaggtttctcctttgcaccattgacgctggagttggcaatgacttgcttttccaatgaaatgtgaacagacatgacatatgctgtgtttgagcaaggttttaaatgtgcttgccttacttggcttggtctcttgcactactgcaacccaccataagaaaagcatgccccatgtagctgctatgcctttcacctgagtcccaaaataagaagcacatggaacagacctaaagccaaccttcaacttgaactcaagctcagaaaatcccatcagctctcataaaaaccaagcaaagccataccctacctacaaatccctagcaaaaatataataattcttattttggcaagcctctgaatttttaaatcatttgttagacacagaaaacaggtttatgcttatgtgttttatattctccctaataattgtaatatctgaagtgttttaggttcagtctgattcttttatctgtagtttctgccagctgtcatggtgttcatttgcttcagtgttttttaatttttaactgagaatttatattccttgaaactagatatttattaagcctagttcaaggacttctgcaaagagttgtgacatttgtttctgtcaagcatttttggatactataaatctaggacacttttaacttagttatcaaattgagaggttgttgtttgtttgtttgttttgtttttagcaactcaggtggtgtcaattttgcctacacatttcaatcattgctaatttttagttaatattcttaggatagatagcttttttccccaacaaacacaaaagattaagacacttctccttgctgttttctcagagtaaggaagtttagacttcatcaaacaattcactgcaaggcattctcagttataagaagggaaaagtcctcatattaggcttgatctcttgtccatgatgctttcaaagccatgcaagttaaggttaccagtcttcgtcaattaccttcagagcaaaagcagtaagcagagctacgtttatctttctgagttcctattttcatgttgattttcatctccttcctttcttgatagctaataaaaaagactcacataaaacctgtagcttctagttgttttcagcaaaagggtcaattagattatctaatctgccatataactaaaactggactttcccacttgcattgtcttttgtgtatttgttgaaatatctcatcttcaaatggcctcatctgttttctttgtgttgttcaattattcatgcaacaaccatttattaagtgcccacaagcaatgcggtactttttaggttctggagatacataagcaaacaatgcagaagaaatcagtatcctcatgggctgataattttggggggcggtttaaaaatttaattctgtactataattttataaaatccaaggaagaaaagggaaataaacatgagtgaccagtaagtgactgttagctagaaatttccccaaatgctattcaatttctacctcttttattgagtttaatacatcctgtttggtattcacgttcttatgtacttgttaaatactcacgaaatatttcattatacaaatgaaaacactttgttacctttgattagctaagaaaatattaggtatcatttatatttcagttgctactaagttataaacttagtagaggcatatatcaaaaaaagtatatcaaaattatcatgtaaaacaacacttttcacttagcaaatgtcagagaattttttttaattaaaaggcaccaccgacaaggtgaggtaaggcagaaacatctggagatccatcatacactagaactgcagggaccagagcagagactgaacaaaacaccctcagtttacagatagatcaaatgccaagaccagaaaggtgatactacttacccaaggtcttatagctatttaataacacaactggggaactggggccaatatttattttagtatatggaaatgcaatagagtttttttaatactgatttagctattgtgctaaaatattttattatttctaatattttgcctgtaaaatgcttttgaactttcaaagtagatgatcagatcatctgcaaataatgtagttttacttcctaatttccagtctttgtgatcttaatgtattttcctttatgggttatactgcctggaatttgaatgcaaaatctttaactaaagaatactaaattcatttttagtactatcgattttcaatgttattattggtattgatactattataataggaaacacctatatagtagttactatgttccaggcactgttctttgtcctcacaacaaccctatcattctctccattttacagggaaggaaattgaggaagtacaaataatttaactgacttctctaaggttatgcagttagtaaaaacagagacagaactgaatgttggcattttggcttcaaagtatatattcttgatctttaagtccactagatttatccactttattctaaattttgagaggctaaagaaacctatcagcccaaatattttatcatactacataatctttcatatcatcttctcatgttttgaggttgactttgtagcttgctttaaaccgcgtaaagactggagattgttgtttcatcagtaactttattattcaaagaagttctaacacagccagagcatacatttcagttgtattttacatgtctgcatggtagctaagttatttggtaagaatttttcatttttagttcttaatatagttgaagacctttaaatatgaagagaatctagaattgttctatagacttcagccaaacaaaacctcttatgtacagtaaaaggatacatttccaatataatccttttattacagaaatgaccacactcaattttattagtgtgtttacacatttatttctgagacagtgatttttctgggggcctgggttatatctttcatgtttcatccttgatgtctatcatatagtgcctggcttatggcagatactcaataactttgctgaatgaataaaaggcaacaacctgtggcacatttataattatccctatttggcagatgatgaaaagaagtttactagaattcatgtgacctccaaggttacagaatttgtcagtaagcagaaacaggattcaatcctcaattttctacccaaagccacactttttcaactaaaccacaaaatgcatagaaaaggatttactgtatatattcacagctagtccatgactaaaaatcttgtggcttcctgtgtcatttgcataataaaactaaaagtataaagaaatagaatggaaatactaaaccttatgtcaaatttataaactgatctctaaaaccagtttattttgtaaatatagtaacatatgtcagaaaaccgctcaggcttctttttctactagaaaagtctttatgtttttctcaaaaatgacatcctttgccaactctgaatatgacatagtgttaatgaaaatctatgcatataaaaatttcaaattcatacttacatgagaaaatcatgaagaattggagatacgccaaaatagcaaaggcaggctaaacttggtctaatttcaaagcagaagaagtaatcaaatcccaagaaattaagatgtgtacgtataattttattcctggcaagagaaatggtcataaacatattttattagcatgcagaaaaagtaagttgatcacatggaaccattatgggttcacttggaatagattctctcaaacctcaggataataccatagagaaagtgaacctgacatgtaacatgatctctgacatgtaacaaaatatcccagaatctgtcatgtaacaaagtctaatgccacattacaaagcctctcatgatacacctgtgaacaagatgaggccttcggaatttgctataacattgaataatagttggtgctataactgttattaacaccataataatagttggtggtatacaaggagttaacaacaaacttattgctattaactccttgttgtcataaccattaggtcagtggatccagcttttctgggaatgaagagaaatagtgaagaggggaaggaattttcaagaaaatagcaaaaatatggagtgaaactagctgcttcagggactacatcaagaggcacatcagttcaaagcagttctagatgaaatatcaagaatcagagaagtattacctttgaggactgacagggttgcaacttcagaagcagagaggggaaaaggtagaagatttcaacacagacacatatcccatccagacacaagtcacaagataaaaaatgccagttgcatccacttcctcccaactcccatcctagaaaactgctgtggtattaaacagaaaagtcagctctccataataaagaaaacactatgctcatctccatactcatgaatctaactgcttactcaaacatctagacctctatcctcatctctatactcatgtatccaagtgcttactcaaacatctccactcggatgtctggcaagcatctcaaaatcaatatgtccaaaactgaattctgttttccccctgaaacttgctccatccacagtccttcccatcacaattctaacaacttaatctttccagttgttgatgtcaaaaaccttgaagtcatgcttgacattcctttcctttcatgtaacagccaatctgccaggaaatcctgtcagatctacatccaaaatgcaccgagaatctggctagttctaattactgttatcatccccaaccaaagcaccaaaaacttttcttgggactcttacaacaacttcctcgtagatgttcctgcatccaggcttgtttgcctatagtatgttctcagtacaagtgccaatgcgatccttttaacacttgagtcagatcatttcattccactgtccactttaacagctctccatttcactcagagtaaaagcccaaagtcctacaaagcctataaacccacatagcctggtccctcattaattctctgactcctattactccccgtcactgactctgctcattgccaaggtgccagtctcactcccacttcagggcctttacttcattccttctgcctgggattctagcaaatgattttcatgactcactccttcacctttaagacttttctcaaatgtcacctcattgaggcctccttggtcagtttacttaatacaacaatctgtccatccagctcctgaacatctcttatctcccttgtgcctctattgtgctttttcccatagtaattatgaccttctaagaaaatacattttttacttcttgattgcttttagtgcttactatctatcttctgctaggtaaaggtccatgaatgcaggattctttttctgttttctcagtggtgtaccacaaacatttaaaagggtgcctggcacacagtcagtggtcaataaatgtttgtagaattaatgcattttagaacttttccacctacaccttgtcccagtacccaggggtaaggcaatgagaaagctgcactctttcaccaggacagagaaattcctaatattgaagaaatccaagcaaaaaagaccaggacatgagaacaaggcaattctgggctagttgccagctgagagcatcagaaaagccctttaatcctttggccagggagtgccaattctttctatatctacagggtatgattagaaatatatttacacaatgcctgattggttgttccttggtctggaggcagggaatcctacacttgcaattaattaatactccttcccagtaactgagatgaagtaaggacccaaccagatttggcaatataaaagatgattgatttgtaatcccagtactttgggaggccgaggcgggcggatcacgaggtcaggaggtcgagaccatcctggctaacacggtgaaaccccgtgttagccggacgtgatagcgagtgcctgtagtcccagctacttgggaggctaaggcaggagaatggcgcaaacccgggaggcggagcttgcagtgagccgagatcgcgccactgcattccagcctgggcgacagagcaagactccgtctcaaaaaaaaaaaaaaagatgattgatttgtgtgttaatgtcaactatttccatccagttttacttccatgaaaagacattagcacactcacacaagatgaacttagaatgttctaaaaaatctctcatgaccacctacagttttcctagggaatttctaaagacttacctctatgagcctatctctatgagcctaactcacttttcctagtttcttctccccacattggctatgttcctggctgcttctttcttagatgcccttgggcactggccttgtccgttttagaacaggaccttattatctcttttcttggatagcctcttaaacattaccaagaggaaccacactatccttaagtcatattggatatctgaaattccaccttgtcataattgttccacatccagccccaactggatgagaataagaatttgacagccgagaagccatattccagtggtttctactatcttttaatttggtccagtccctttcaacatcttccctcaatgacttctataattacataaataacatgtttgtcaaatttttaggtgacaaacagttgataaaaatatctaatattttagataataggctcaagactccaaaataactcctgcaatttaatgaacaggccaaaatgaataaaatgcctatttatggagataattaggccagtgtgtgatacatagtggcattctataaaagtttgtggaattataaaatgaataaattgatgcagactcttctactgagattctaaaaattaactgcacaagttcaggatgaagaataacctagaataagagcagtttctgagaaaccagatttacaagtttattggataccaagtgccttataagtcagttctgtcagaaaatagggccattgctgttgagagcacaccaacaactaatgtgtcagtttgtgagcttcacattttttaattgatattgacaaatttgagagatacctgagaagaatcattgcaatattgaaagattacttgacttattcattcattaggtaatcttgaatgcctactctttgatgagccttggaatagtcattaaggataaatggtgttcatataaggagtgactgataaaatggaatatactgcatattttatttttattattaatattaaaaagagtattacagcatttttagttaatatatattattggtatattataataatacaataattactataataaataaaacaatatattatgatttaacagtatattattttatgccatattatgaatatgacagtatttcattttactccatgttattaacaagtagtaatatcatacgcataagtccattttatatgacaatctttcctgtattagaattccagtggaagctagaatgtaactttcataacagaaagaatcctttatttcatgtaatttccaattaaataaaaactttcaaatatttgagacataatctaaatggctgggcgcagtggttcacgcctgtaatcccagcaatttgggtggccgaggtgggtggatcacctgaggttaggagttctagaccagcctggtcaacaaggtgaaaccctgtctctactaaaaatagaataattagccagacacaatggcaggtgcctgtaattccagctacttgggaggctgaggcaggagaatcgctggaacctgggaggtggaggttggagtgagcagagatcacaccactgcactccagcctgggcaatagagtgagatcctatctcaaaaaaaaaaaaaaaaatatatatatatatatatatatatatttgagatataatctaaatatggaatccttccaaaattttgcaaatttcctgaatcattatagttctcttgtttatactttatttgatggtaactcttttgtatgcacctctattgagttgttctgaagtgttcaacccactttcattgtaacaaaaactgtcctttcttagtaatattttattagcttataaaatacttactcaaattatacatctacactaagaactgtaactggcataaataatttggtaagtaacccaagtgactctgaaaacatacaactccactcactggagcacaagtacatgaaagtactagcacctgatatcgatcagaatgttttacagagggaatgagggacagtatttaatcctctaaattggttagtcaattggttaagtggaagctggttaaaataattctaactgaacactaacccagtcttcttagagattccagagttttctctctagaaaatgtacctcagtattacggtcccctcctgaaagcccgttaatggcctcaagataaaaccaagctccgtggacagaatgatatttgagagatgaaatttaacttgtcaaggaacacttcccttcaggttatttttgattgagttctgaatattttagaggaaaatattaattatggaaataatgcaggcttggattgatgtttcctgctccaaggagaatttagatttgcctctggcagtggctaggggcactagcaatgaaacttcacattaggccgtttatagtgattgagtccctaggacaaaagactatttctggttcactgtcccatcttgaatggaggccttaaggtccccagttcaaagcgtgtatggtttactgtggatccccatccacaatgggtcttggactcacatctcatcctctcagttgtctcttcctggattggcaggtgtttctgggtgacaagctgctatacctgccaggctcacccctctgggttttctccctaatctgagcctgtgattcttcaatgcaatgagaatgtttttattccttcagtcagataagattgtttaatattttacccacttaagtgttgattttcatcactttattcctgtattattgaaatcatcccacccttatttcttcataaataaagaagaaccaggccccacatttgagaccagaggaccaaagcattatgtctgcctctgttccttattagatatgttaccttgggcaactttctcatagtctcagttttctacaaagcaaacacaagaattttattcattggtgtatgtacaattctttgagatgctgcatggaaaagcattgtaaactgtaaaatatgacttaatatctaattacattaatatgtgctcctaaacaatgtgtgtgtgtgctttaatttgttatgatacagtgtgcagattaatttatcctttgtcaatatcaattttttcactcatccgtttattttattcacatttattgcatgcctgcactgtgctaaaactgttactgggccttgttgatacagcaataacacaaaataatgcctcaatccaacaaaattctgaagggcttcctcagcccctccatgaccagcccccacccccccaattatacagtctcctgctactcttagtcccctgttataacctaacttcaggatattcatcacaattttacttctatttttattttgtattatttgttaaatgtctgtttcatccactaaactgtaataccctgagagtcactaacatggccacattataatctgtaaaatattgttaaatgacatgaaagagataaatgaatgactaatcgtatggagtctgtaatgcctggtaagatttggtaggaaataaaactagaaaggtagatggggaacagtttgtgatggggcccttaatgtcctgctgtgtaatcaagactttatcctttaagcagtgaggaaccatgggaaactgagataatagcatggacaaaggcaagaagacacagacattcagctcgttagaaacgttgcctcaggtcactgacttagagaagggcagatagaaacaccgagtctcttcttacaacacatgggctcctcaatctggtgaaccactttgcatcacctgacgttataagatattcttctaagaacaatagcactaattgggatcaaaaccctggggtgaggtccatctactgagccaaagctgggtggcagggtgcaataaaatttttatgtgtcaacgtaaacattgtcttttaaaaaaatcattgtatacatatttacatctaccattatttcattagactagattatcgaatgaatgagtctccttgggaattgaaagggtgcattccaccacatctttatagaattattatacatactttaattttgtctttgctggtttcacatattaagtatccttataggagccttcaggtcctttgcagctcctgtgactctaattcagttcactgaagtatctaccattactccttctacccaatgagaccaaacaaacagaaaaaaattggttccttctccgttttgacagcccatgagatatctgaggagagttctcatgtcctgagacttctttttacccataagagtaaatgcctccaactaaggctatttttcagaaacatacaagtttataaaaaatggcccaaaactttttgtagaaaaattttaagtttgaacattgggagttccagaaaaaaaaaaaaggcttctgtccaacacttttcactgctggctatatcatagttcctcactggaataaagaatattctgtttcctagtggaatggagaattgaaatcagagcctctggataataacagtaacaattacaatcataaagatcatagcttacatttgactgcttgccgtgtgccaggcatttttcaaagagcttaaagatattctccccataatcttcaaataatgccatgaagtttgtacaaaactgctcttatacaaagttaaatccacttgtttcaaaaataaggaaagggagaaagaaaaaggataaagaaaacctatattcactaagtcctaataggctatgctatgtatccattttccattgttgctataacaaattaccataaactagtgcataagacaacagaaatttattaacttacagctccgaaggtcatactccagtattggtctcactgaggtaaaatcaaggtgtcagcatgactgcattttattccacaggctctaaaggagaatccatttcttgctttttccagcttccagaggccatttgcattccttgactcgggttcccctctctccatctttaaagtcagcaacagcagttttagtcccctcacattgcatctctgacactttttccatcatcacatgtctctctgatcatggccaaaaaatattctccatttttaaggactcatgttactagattggacccactggataatccagtaaaacttttccatcttaaacttaaaccatccaggaaaactttgccatttaatgtaacatattcacaggttcctaaaacatctctggggtgaacatctctagggtaccagtattctgcatatgaggacctatatatgcaattccatgtattctccccaggaaataaatcctcaagataattataatagttatttattgttgtgtaataaactacctccaaaattaaatagcttaaaatgacatttgctttctcacagtttcctcagagggtcatgaacctggctgaggcttagctgtgccctctgtttcaggttgtctcacatggctgcaaccaaggtatctgcttaggctgcggtctcatctgaaggttcagctgatgatagatctgctttcaagctcactgcttggctgctggcaagattcagtgtcttgtagactgttgactgagggcctcagttccttctagcttttagtgagagagcatcctcagttcctttccatgcaggtctccacatatggcacattccttcatcagagtgagtaagcagagagagagagagaaaaggtgtcaggaaggtggttgtcatggtcttttaaaatctaacctcaagagtgccattccttcacttttgccatattctattagttaaaagtaagttactacatcaacaagaccagcccacatacaaagaaaagaaaatacactatggagtgaccatcatgaggaaagatcattgggagccatttcagaagcagtctatcacagtatttgtatcattttgctattgctgcatgacaagtcaccacaaacatagtggcttgaaatgaaaattcttctctcttattcacatctgtgggtcaactgggacacagccaaacaactctgattcaagttaccggttcccctttgcttgaatccttgttgtggagtgagtgcaagtttgcttcattgaagttcaagctggggtgcctgtaaaatcctagggcagttcttctcacagcaatagcagaagtgcaagaaggaaagagaaacatgtgataacttttaaagccaggattgaggcctattgcatggttacttccctcctccctacccccaggtaccctactggccaaaataagtcacatgcctgaacccaaaataaaaggactagaaagtatattctgcctctagtggaagcaacttcacagtcacaaggtaaaggtcaaggatccaggaagaggtgaaaaattggggccaaaaattccatctctcacaatattatcactcacattttactgataaagaaattgtggtgcagataagctacctgacttgctcaaggtcacagaattcaaattcacatttgtctgacttcaaaacccgttcttcattgttttataccaccacgactcaagatacattctctctgaatcatttccttctgaataaaggagttcacaaattggtatctaaaaattccttttgcaaacagtcatcagaaatttcactttgctcttctgcctcctgtttcactttatcagcctaaatttgtaacatgggcaggagcgtggagataaaatcgtctctgaaaatgagaaaatggattttcttgccatgcctttgcattacaaatgggcccagtccacggcaatcatggctgcacctggaacagtgcacagggcccatgaataatccatgttccttacacacttgtctccctgcggtgctgactcagcaactgctctcctactttctgcaaagtaaagacagcatataggtcagatgaagtctaagagtgtaacaacactctgaacatttggctgaatcctgaaggccgacaagggacttaaaaatttcattagaatttaaccagactgtgattcttcgcttctcagaatttcatttcttcagggttaaatccagatttcattatcttcagggttaaatccagacttctttatatggcacacaggagccatcatgatttgaccattacttacctgaccagaactttatccccgccacccatcccctgcccttcagcttgacccctttttccacctccctcatcttcaaccccagctatacaaaactatttgtattccccaaaaagaaaacacatttatctgcaatcattggcatttgttggtcctttttcctagaaagctcttcctccccttggtcactaatctaaattaagtttcttctttcagaagtagctcaggggctcctttgcacagaaacctattcctaacctcacccttaccctaacacccagctcacttggggttaggagttttttgtttaggaaacagtttgtgcttcgactatagcccttctcaacctatattagaatcacctatttatttttcaatctcacaaacactgagctctttgaaactaacaatattttggctctgaatgcatattgttcttggcatggtgctcagtagtcattacatgattgcaaaaaaataaaaggaatgggaagggaaaagaagggaaggaaagggaagacaaggggagaggatcacagggaagggaagagaaaagaagggaagaggaggagaagggaggaaaggggatgggagggaaggggaggaaagggaagggaatgggaggaaaagggaggggaggggagggggaaaaggaaagggaagggaagggaaaagaaggaaaggggaggggagagaagaggacaggggcggggggagaagggagggaagggaagggaagggaaaagaaggaaaggggagggaaaagaaggaaaggggaggagagagaagaggacgggagggaagggggagaagggagggaagggaaaggaaaaaagggaaggggaggggagaagaggggagggaaaggaaggaaggagaaagagaggaagaatagaaaagaagtagggagagagggaggtaagaacggaaagaggtaagaaaaagagggaagagaggagggaaggagagaaggaaagagggaagaaagaaaaatcaagatcatgtttgagaaagtattttgtaaatttcacatggcttcatacaatcaggagccctattcatttcacctggaataagctaacgtacaaggctagctactcttagggaaagcccgtttttccttaaatcctttgactccagcagatcagacccacctacatcctctgtaaacttaagtgaatgaactttgtaaagagtgttgcctcttagccagcttctccatgtactccagtgtaatcaataaccaatccagagagcaaattaatgttaaatacagcttgaagaatggtggaaaaaaaaaacagtaggggagcattagcagagagccttcccagaattgtagtctcagggactgtaggttggttcagagattatcataatctgcaagataggagggccctccagaaatagagttatcattcctgctataaaaattgtgcccctgaattaacacaaacaagaatttccagatgacagttccaaatgccaattgctgctattttcacttcaacatcataattgactgagtgtgattgcttggtggttttgaagctgtctttgcaccctaataattgcactttccaaattccatctgaggcattaccatacctgataaggctcttaactgatgttttaatataatggcttggaacatacatctttggaaagaatagttcatatagaagatagatcaaatatgttctaggattattctttacagtcactataataagtgtttcttctactttccctcccaccacacacccccataaagtcaacaactttatggcattaggcttcaaagagttgctaaaactctggaagctttgctcttctgagaaaaaaaatcttatttcatttttttccctgtaaaatcgccataatatttaggtggggaggagatatgcagctgttatgatttagagttgctgagcttctgacccttgtcctggctaaaacagtgtttggatttgagtagaaatagcaatgaacctagagcaacttattagctgaaactctgagtctcaaaattttttcatttataaatagcccagtgaaaataacttacatttcactggcctattgtgagaatctaatgaaatctgatggataaaaagcaaggcaaaaactaaactattctgtattgttggggaattatgaattaatattattgttatggcctaaaattagttgaatagagccagaaaacagagtagatgtggtgcattaatctacttgagctaccataacaaaataccacacgctgagtggcttaaataataaaaatttattttctcaccattctggaggctggatgtcctagatcaaagtccagcagaactcagtttctggtagacgcactcgtcctggcttgcagacatcccctttgtcttcacatagcgtattagtccattcttgcagtgctataaagaagtacctcagactgggtaatttataaagaaaagaggcttaattggctcatggttctgcagactgtacaggaagcatgatgatggaatctgctcagcttccagggaggccacaggaaacttaacagtcatgccagaaggtgaagagggaataggcatgtcacatggccagagcaggagcaagagaacgtgaagggggaagtgctacacacttttaaatgaccaaatatcatgagagctcactattgtgaagacagtaccaagggggatggtgctaaaccattcatgagaaacttgcctccactgggtggggggacccaatctccccccaccatgcctcccctccaatactgaagattacattttgacatgacatttggttggaggcaacatccaaactgtatcacatggccttctttctgaatgcacacagacagagacacgttccagtatctcttcctcttctgaaaagtgcaacagctctatcagattagggctccacccttatgacctcatttaaactctaccatctgcttatgaccctatctccaaatacattcacattggttgttagggtttcacatatgattctgggggtgggagaaggtacaaacatttagtccttaatacatgggttatcaaaaggactccttttcaaatgttatcttttttatcattaacagaaatcacatgccacttcagattaaaattattatattttgggctggtttaaaatgttagcttttggggaatgaaagacactggggtctacttgagggtggagggtgggaggaagaagagaagcacaaataataattattgggtactgggctttttgcatgggtgatgaaatcagctgtacaacaaacccctgtgacacaagttcacctatgtaacaaaccttcacatgtacccccgaacctaacataaacctttaaaaaaatgaaatgaaatatcagctttttagccaacaaacatatgaaaaaatgctcagcatcactaatcattagggaaatccaaatcaaaaccacagtggaataccatctctcaccagtctgaatagctattattaaaaagtcaaaaataaaagctgttggtgaggatgcaaagtaaagggaatgcttatacactgttggtgggtatgtaaattagttcagccactttggaaatttctcaaagaactataaataaaactatcattcaacccagcaatcatattattgggtatatatcctacagaaaataaatcattctgccaaaaagacacatgcactcatatgttgttcaccgcagcacagcactattcacaacaagaaaaatatggaatcaacctagatgcccatcaatgatggattagattaagtaaattttgtacatgtacaccatggaatactattcagccataaaaagaatgaaatcatgtactttacagcaatatggatgcagctgtagttatcctaaatgaactaacacaaaagcagaaaatcaaataccacatcttctgacgtataagtggaaactaaacaatgggtacatacagacataaagatggagacaatagacactggggaccccaaaaggggagaagaagggagaatagaaatggttgaaaagctatttattgtgtactgtgtttactatttggttggtgggttccatagaagcccaaatcccagcatgatgcaatatatttatgtaacaaacctgcacatgtaccatctgaatctaaaatttaaaaaaatttttttgaaaaaataaaaaataaaatgtcagcttttcaaagaagtctcctctgctgcccgctcaggactaatccctaccccctccttgcacctactggaacccttctctccagtagtacttaattcattatcatatgtctgtctgtcttaggaagaatgaagatttctctgagtcaaaagacatgtttttctctcaattttatataaccatattattgaggattctcaatatgatgtggtaaaaacacgaatatattttctttttttgccgttaacacctttagccacattctgacaaatcatcctttccaatttctttgcaatatcttaggtagattttatcatttctagtcatttttcattactaaatgtacaacttaaactttaatctcaaaattgattgcaaactcatccattccctcttttcccagcagaagtcttgtgctgtgatgctggcttatcagaaaaaaggatcagagatgaggctgcatagacttagctatgagatttgtgcaggccaaccacatgaattcacacaggatatgcaatgctcaaccctagggagcaagattcatatggtataccatgttaaccactctccctatagttgtccagtgcacaatttccacaaccatataagaaagctctgaattacatatgcaaatcttatatgcataactgtataagaaagccctgtagtcttacatttgctcttccaagtataattattccagagtttaataaagatccaaaaacagtagaggaaatcaaagtcttcttgtataaatggttaccttatagaaaagggaagccatctttgatcttatctatgctatagactgaatgtttttgttcccccaaagttcttaaattaaaatttaatcaccatcatgatggtactagaaatgagagctttaggagggctctgccctcataaataggatgagtgctctaataaaagcgacccgagggagctccctgggaccctcagctatgttgaggacaaagcaagaatatggctgtctgtgaaccaggtagcaggccctcatcagacaccaaatctgctggtgctttaacctaggacatcccagcctccagaaatgtgagaaatttatctgttgtttataagccaccccatctatggtagtttgttacggcagcccaaatggattaatacaccctgattttgtctgtttatcttctcctggtgatgtctacaaataattacaacaattacaagtataattataataatgtattagataatgtttctggaaaactcatcaccatatttcataaattctaatatatgttctttcaggcatcaacatttctgaaataacgatgtggttttcaataaatgatatatcatggttttattgtaagcatttttccctctcttagtggtacataaaccccattgtcaatattagatggatcaatgagacagaaaattaacaaggatattcaggaattcaactcagctctggaccaagcagacctaagagacatctacagaactcttcatttcaaatcaacagaatatacattcttctcagcaccacattgcacttattctaaaattgaccacataattggaagtaaaacactcctcagcaaatgcaaaagaacagaaatcataacaaacagtctctcagaccacagtgcaataaaattagaactcaggattaagaaactcactcaaaacagcacaactacatggaaactgaacaacctgctcctgaatgactactgggtaaataacgcaatttaggcagaaataaacaagttacttgaaaccaatgagaacaaagacacaaggtaccagaatctcggaaacacagctaaagcagtgtttggagggaaatttatagcactaaatgcccacaggagaaagaggaaagttctaaaatcgacacattaacatcacaatgaaaagaactagagaagcaagagcaaacaaattcaaaagctaacagaagacaacaaataactaagatcagagcagaactgaaagagatagaaacatgaaaaacctttcaaaaaaatcaatgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaatcaatgaatccaggagctgtttgtttgaaaatatcaacgaaatagatagacctctagccagactaataaagaagacaagagagaagaatcaaatagacacaataaaaaatgataaaggggatattgccactgatcccacagaaatacaagctaccattagagaatactataaacacctctatgcaaataaactagaaaatctagaagaaatggataaattcctgaacacatacaccctcccaagactaaaccaggaagaagtcaaatccctgaatagaccaataacaagttctaaaattgaggcagtaattaatagcctaccaaccaaaaaaagtctaggaccagacagagtcacagcagaattctaccagaggtagaaagagcagccggtaccatttcttctgaaactatttcaaacaatagaaaaactcattttatgaggcatgcatcatcctgataccaaaacctgagagagacacaacaaaaaaagaaaatttcaggccaatatccctgatgaacatcaatacaaaaattctcaataaaatactggcaacccaaatctagcagcacatcaaaaagcttatccaccacgatcaagttggctttgtccctgggatgcaaggctggttcaacatacgcaaatcaataaatgtaatccatcacataaacagaaccaatgacaaaagccacatgattatctcaatagatgcagaaaaggcctttgataaaattcaacaccccttcatgctaaaaactttcaataaactaggtattgatggaacatatctcaaaataacaagagctatttatgacaaacccatagccaatatcatactgaatgggcaaaagctggaagcattccctttgaaaaccagcccaagacagggatgccctctctcaccactcctattcaacatagtattggaagttctggccaggacaattaggcaagagaaagaaataaagggtattcaaataggaagagaggaagtaaaattgtctctgtttgcagatgacatgattgtatatttagaaaaccccatcatctcagcccaaaatctccttaagctgataggcaacttcagcaaaatcttaggatacaaaatcaatgtgcaaaaatcacaagaattcaaatacaccaataatagacagagagccaaatcatgagtgaattcccattcacaattgctataaaaagaataaaatacctaggaatacaacttacaagggatgtgaaggacctcttcaaggaggactacaaaccactgcttaagaaaataagagaggacacaaacaaatggcaaaacattccatgctcatggataggaagaatcaatatcatgaaaatggccatactgcccaaagtaatttatagattcaatgctatccgaatcaagctaccactgactttcttcagagttagaaaaaactactttaaatttcatatggaaccaaaaaagagcccatatagccaagacaatcctaagcaaaaacaacaaagctggaggcatcacactacctgacttcaaactgtactacaaggctacagtaaccaaaacagcatggtactggtaccaaaacagatacatagaccaatggaaccgaacagaggtctcagaaataatgccgcacatttaccaccacctgatctttgaaaaacttgacaaaaacaagcaatggggaaaggattccctatttaataaatggtgttggaaaaactggcagaaggtttcaaacttcaaaagctagcagaagacaagaaataactaagatcagagcagaactgaaggacatagagacatgaaaaacctttcaaaaaaatcaatgaatccaggagctggttgtttgaaaagatcaacaaaatagacctctagccagactaataaagaaaactgaaactggaccccttccttaccccttatacaaaaattaactcatgatggattaaataatttaaacataagacctaaaaccataaaaaccctagaagaaacctaagcaataccattcagagcataggcatgggcaaagacctcatgactaaaacaccaaaagcaacggcaacaaaagccaaaattgacagatgggatctgattaaaggaaagagcttctgcacagcaaaagaaaccatcatcagagtgaacagggaacctacagaatgggtgaaaatttttgcaatctatccatctgacaaagggctaatatccagaatctacaaagaacttaaacaaatttactagaaaaaaacaaacaaccccatcaaaaagtgggcaaagaatatgaacagacacttctcaaaacaagacatttatgcagccagcaaacatgaaaaaaagctcatcatcactggtcattagagaaatgcaaatcaaaaccacgatgagataccatctcacacagttagaatggtgatcattaaaaagtcaggaaacaacagatgctggaaaggatgtggagaaataggaacgcttttacactgttgatgggagtgtaaattagttcaatcattgcggaagacagtgtggtaattcctcaaggatctagaacaagaaataccatttgacccagcaatcccattactggatacatacccaaaggattataaatcattctactatatagacacttcacacacataagtttattgcagcactgttcacaatagcaaagacttgaaaccaatcaaaataccaatcaacaatgatagactggataaagaaaatgtgacacatatacaccatggaatactacgcagccataaaaaaggatgggttcatgtcccttgcaggaacatggatgaagctggaaaccatcattctcagcaaactaacacaagaacagaaaaccaaacaccacatgttctcatcataagtgggagttgaacaatgagaacacatggacacagggaggggaacatcacacactggggcctgtcagggattggggagctagtgggggatagcattcggagaaatacctaatgtagatgatgggttgatgggtgcagcaaaccaccatggcacgtgtatacctatgtaacaaatctgcacgttctgcacatgtatcccagaacttaaagtataataaaaagaaaaaaaaacatggggggaactgcaatctttgtcctcagtgcagactctattcataattctggcacataatttgtgcttcaagttaatgagcaacttgccagtatttgaatggtttcaaggttttcaacagaaatttaggatcctatatgatgttgctcctacctaactggaaaaccctgccttcctgcacatttcccagtatatcttgtctcggggtctttgttcatgctattcctgtgtctggaattcactttccaagcaatccctttctccatatcttagctaacgcctcagatccccaacaggattaactctccctgctcagagcaacaacattcagtaaccaatcaatactctgtcacattaggtttttgtcaatctgaaatattgtgtagcggagtcaaacctcccttttaaagaacctgctgtggggagtgtagttgactggcagcctactgttgccacactttggaatttgatgtgatattgatttggctgtgatgccatacttcctctaagctgctcttagccactgactgagcatggtaggagagatatgagattcaggtctttaatgctcccaaacaggacttttctaatgggcaacttttgcgtggcaactcccaatcagcctagcgaaatcccactcaaagatgtgccctgtctgaggctcttcctgcctgaggctcttcctgcccaatctttcttcctctcccttcatagttgttgtatctgactcacagtctgaatgtttctcctgccttttgcttcctccctttttacctttcgttagcatttcccgcaataaatctcttgcacatctaattgtctgattctcagaggacccacactgactgcctggcagagtaggaagtgttcaacaatctgaagattgcatagagttttgtctataaaatacaattaactcctgagaagaataagatgtatatctgttttcaaatttgacattgataaccactcactaccttcttcttgaagtccctccctcaacttctgaaacaactgggatctgtagagaattacgagtaagatttcagggacttcatggaccttctgaaacttacccattaagagcctctggtctgcaagacaaggtcaaaattcttaatgtggcttttcaaacacccagtaagcagccccagcctacctctagccatactgaagtgcttgggtttcctggggatgccaggctctttctcatcctcctgcctctgcacttgctgttccctaacctgaaattccaacttgtctccttgcccttttccctaactcacactggctattgacctggaaaatccctactcctcttccaagagtcagctaaaacaacagcaccacttcaaaatcttttccatgtccccagcacaagcacaaaacttctttgtgccacctgcccccttactctgtccacagctctgtgataaatttaaatgtatttttcttatgtggcttccaaaacagtggtctccttgaaggcaggagctgttgtacttttcttggcttcccagcacctagtacagggcctgtcccacagtggacactcaataagagtgttgttcttgctgttgttgctgttgttgttactttcaatctatgaatacccacactgaatgctgcacccaaccagctgtgtgaccttatgggctcacaaaacaactctgagcctcagtgttttcttccgtaaagaagggataataataatgatgacttctgggaagtgctatcacaaagatcatgaatacaaacacaatggaggcatttcagtccttgcttactggccctttccagttcagcactgttgatgatgccctccttctgaacactctctgttctctattccttttgtatttctcttactttatttcattatagtcaccaagtcacccaagtcaaaacctgggtgtgatctttgagtccgccctccccctcattcactagtttcaatcaattacctatcaagtcctgtaccttttgccatctgaatagttcctctactttcccactgactgtggactagtttaggtcaccatcaccccctggggctattacaatattatatcaacaaataactagtctctctgcatctgaccctcatgccctccaatccattctctacaccaatggcataaatctgaccatgtcactctgccactgagaatacttcatgacttcctgatgcctaataatgcataacttttaatgaatgcttgcttgctccatggctagcaataaaaaagttgggtaggcatcattattattctatgatgtgaatgaggaatttgaagcacaggaaggataacaatgagcaacttgccaatgtttgaatggtttcaaggttctcaatagaaatttaggatcctatatgacgttgctcctacttaactggaaaaccctgccttcctgcacatttctcagtatatcttgcctcggggtctttgttcatgctattcctgtgcctggaattcactttccaagcaatccctttctccatatcttagctaatgcctcagatccccaacatgattaaatcttcctgctcagagaaacaacattcacattacatatatttgtcacgtatttaccatgatacatagagatatagatacagatacaaatgtaaagttatgcacctctctctcctggcatagacagactgataattatggatgataatagcagtacttataatgctaactgccaataacgatatattaaagaactaaatgacacaacctagaaatgtgcataaattaactcccaagaaggtgaactttaaccagtgagataaagaaaggaaccaagcaagtaaaatgtctctccttctgtcctctctgggagtgctctgaaatctgggctctttgtacatcctgctgagaaatgtttcatggggccaagtggacccaactgctgagagatctgaggtcaatatttatggtgtttgtgaagcaaccgatgatgagtaacacatcaccttgccttgcttcccaacttccagaatatggaatatgtactgaatcaaaaaaaactatacatggcactgaatctacaatagctacagtgtatgggtcaggtatcaaggggtgaaagtaagtatgcccactctcacatccagggacctacttgcaagattgtgcttccttctcccacaactttgttcttgagtatagggtacacatccaccagagaattaaataatggttccactaaactggaaacactgtaattatgacgtgcctactttaagcacatcttttcagtggaactgtagacaaagaaagacgttactatgtcataaacgcagcagggaagagtatatgtggaactcaggcaattcactgaagggtcttttaatatttccatgctgactaataatcatcaatgggcaatgacagtaaccacaaaccccaccagagttgggcaagtaagggcttatttccatcagcaatgagggtctgtcttatcccaacaggcaactaactggactaactgaaatattggccaatggtgagggaaatctaaaatgataaaggatggagataataaatgtcgttcacggcctcagcatcagtttcagcagcagaaactatactttgtttctgtaagcttcgtggcttaagtcttgcagacaacaaatgacaaacaatctagaggaggattctaccagtgattggacctgttcttccctctttgggaaggaataagaacaccaaaaaaaaaaaatactcgggggagaccccatattgtagtacaagagccagatataagagggcaaggggggattggaatggcccaggaggggaacagatgggacatcttgggtcagatttagattcccttggcttcacccatctcagaggcctttggatatttgttttgcattggcattgttgtattgacacacttagtacaggtctgtgtggttctaccaaatgaagctaaacatatacttgctcaggaaagctggactctcttctgtaacagacaccacacaaccaggctgaccagccatgtgtccagtgtttctgtctctccagccatttctgcccttagatgaaataccctaccatagaattcaggatctagtttcccaaaagccacccaggaagacaaataatgtacctggaaagcgcagaggaattgatatctttgggggcaaagtttgaatagtagggaaaaggaaaagattggagagagccaaacagataaactccctcttccttcttctcaagtactgttctctggtgtgctttctctttacagcctctccagaggcattctgcaaggccaaacaagcacctccaacaagctatctgctgaatacatcacactgcactgcttcctatacttccctgactcaatttcttttcccccatttttattgccctatctttacagctcccagagagagcatcagcagttaatcttggcccagatgctattttctgggggaccatggaaaaggcagatataacaacaagaacaacaatatgaaattattattattattatagcaaaacttacttttattgggtcctactctgtgccaagcactgttctatacattaactcatgtactccattaatagcaggagtcatggcttattaatctttgtaaccccagtacacagcacataacagggcagatggtaggtagtctcagaaaatgtttgagaaataatacatgtctccataacagagctttgaagctagtcatttgcaagacctccattttaatttagctgcatttctcaaaaccagtcctagtgagcacttaccaggcaccagaaatttccacatattttgtctcatttagtacccaaaattgtcttgtaatataacattataatatgttctatagatgataaaactgaaaccagtggaggtagaattgaatctcagaatggacatttacttaccctaagttagaaaacaatattaaataaattatttaacaagtctgagccttttaaatggtgatattaacaagaaatgccctactttcttaaatggctattggcagggtgaaaagtgaattgttctacaggtgccaatttccaaatattgatgaggaaattcaggctcaaaatattaaaagccttgctgagtgtcctacaaatttcatagtacacacatgggaattttctctgaatcgactgccagaacaatttatattataccttattgtggatcttgggtaaaagtagagaacagatttcagatgtcctcattctacccatctgtgtccccacaacacatttccaaaaacagcaggtaggagtacagcaggcaggattccctttagggactgcataccatgacaactttcaagagaccggagcacaggggattatcagtttgccaatgtgaaaacaaagctttccttattaataagtccttggcacttgataattttcccagggctttaatttctgttaatggttagtttgtaagtttaataatataacttagataaaagaaaaaggtgcgtgtgcagacaatgcggcaatgtctacttttaaagcaaaacaatatttgggttgttgagtagagtcagaaaaggagccaaggataatagtgaacagcaacaacaaatcctgtccacttagtaacttcagggttcaggttagggacacaatgtagcattctatgtcagagatgtgggagcagcacttacgcacatggccagactcttcacttctaagcaatatgttcttccctgagactatcagcggtggtttagcatgggttaaaggaagatgatcttttctttttcttttttcttaacattttaattaacataaaataatgattatttatatttttgagggtatagtgtgatgttttgtacacattgtgaaatgactatattaagctaattaacatgtctatcctctcacacacttaatttttgggggagaacatttaaaatctactctcagcaattttcaaatatacattatcattaactatagccaccatgctgtacgttagatctccaaaacttattccccctatctaatggaaactctgtatcctttgacaagcacctccccattcccctgagtccccatctgctggtaaccaccattctactttctgcttctgagtttgatttttttagatttcacatataagtaagatcatgcagtatttgtgtttctgtgcctggcttatttcacatagcataatgttctccaggttcattcatgttgttgcaaatgacagaatatcttcttttttaaggctgaacagtattctattttgcatatataccactttttaaatgtattaatctgtggatggacactgatcttggctatcgtgaatcatgctgcaatgaacatggacatgaagttatctctttgggatactaatttaatttccactggaagcccaaaagtgggcttgctggatcatatgctaactctattttcaattgtttgaggaacctccatactgttttccttaatggttgtactaatttacatttccaccgacaatgtggaaggttcctttttctccacatccttaccaatacttgttatctttcatcttttttataataattatcctaacaggtgtgagatgatgtttcattgtggttttgatttgcatttccctgataattagcgatgttcagcattttttcatatacccactggccttttgtatgtcttcttttgagaaatgtctattcagatcatgtgcccatttttaaactttgatctggttatttgttttattgtcaatttgttgaatcccttatatattttggatattaacccattatcaaacgtatgatttgcaatttttttttttttttctgagacaggttctggcactgtcacccaggctggagtgctgtggcacgatcttggctcattgcaacctccacctcctgaactcaaacaatcctcctgcctccgccccccaagtacctgagactacaggtgtgtgccatcaagccctgttaatttttgtattttttgtagaaatggggttttgccatgtttcccaggctggtctcaaactcctgaactcaagcaatttacctgctttggcctcccaaagtgctggggttacagacatgagccactgcttccggccaggtttgcaaatattttcttctaattcataggttgtctcttcactgtgttaattgttttcttttctgtgtagatgctttgtttttggtgcaatcctctttgtctatttttgcttttgctgcctttgctcttggggtgatattgaaaagcccttgcccagaccaaaggaatgaaggttttcccttatgttttcttttagtagtgttacagtttcaggtcttccattcaagtctttaatcaattgtgagtttatttttgcatatggtataagaaaagggtccaatttcattcttctgcaagtggatatcctgttttcccatcagcgtttattgaagagactaacttttccccattacatgttcttggggaaataatacattataacacctttgtaaaaaatcatgactatatacatgtgggtttacttctgggctccttattctgtttcatttgttgctatgtctggttttatgccagtatcatgctgttttgctcactgtagctttgtaacatattttgaaatcaggtagtatgatggccaccagatttgttgtttttgctcaagatggctttggctagtagaggatttttatggtaccatgcaaattttaggattggttttttttctatttctgttaaaaatatcattggatttttttaattggaattttgatagggattgcattgaatctatagattgctttggatagtatggacattttaacaatattaattcttccaatccataaacataagatatccttccatttatttgtatcttcttcaatttcattcatcaccattcattttatagcttttagtatatagacctttaacctccttagttaaatttatttataggtatattttgatgctattataaatgggattattttcttaatttctttttaagatgcttcgtttttactgtacaggaatgctaccggttttgtatgttgattttgtgtcctacaactttactgaatttgtttattagttttatcaggtttttttggtggagggttttctatatataagggttttctatatataagatcatgttgccggcaaagaccatttaacttcttccttttttatttaaatgccttttatttatttttattacctaattgctctggctaagaaaaatgtgctcttgaagcataacatttagaatgtatctgtggtcacagagtgggatcttggcatgtctcgtcaataaatggtgttgagaggaaactggaattcaagaagtcctctgtaatttttgcagtcctatgcaattgcagagctagaattcgtaaaagctatagtaacttgagcaaaaccacagaggttaggttttccatattttgttaggccccatttagctaaagcatatggtatgggaggtatgcctggaaatgtcgcttttggtaaaattgcaagaggactttgaatgctttgtgggcatttgtgaatgttcaggaggctatgagaaattaattaagattcttgacaaatgaaataacatgacttgaaatttacttcagaaaaattaatcctgccacactgtgtaggttgaattggagtaaaaaaaaatgcaaataaatgggacaagcaattaaaaagatgattatagtagctcagaaaaagaagaaatgagacgtcccagggatttatttattctcagttctcagactgtgttatggaactttcaagttgccaggtaagagccttccaaataaaaaagtaggtgtccttgtcattcccaggaattctcatggtaaaaggaaaagacaagtaattctagataaagacatttctggggagaggaaagagaactctagctctctggggcagaggctgctgaatacaatctcataaacatttcccccttctctcattgtaatagaagcctcaattatttgagacagcaatgaacctagctaaaagactgcgtttcctatcctccttgcacctgactgtggtaaaatgaaaaagatctaagtaatgaaaagtggtagaaatagcagaaaagctgctaaaggaaaccgacttgactggaaactgggcccttttgtcctatcctcctccttcctgttgccagcctggaacaatgatgtaatgttccaactgccatcttggacaatgaggtgaccttgagaatgaaagcaatatactgatggtggtaaagcagaaaatggccctgaacatcttttgcatgaggggcaaactcctctcttgtttgagtcactattgattgtttggtgtttcctatgaatattatacacagctaaacctagtcttaagtaatacatccactttgcaaacgtaaactttgggagcctgggacttagagttagacttgactctcttaaagtaattattaatttattaaaataaagaatcccagagatagtaactactataatcgctcacttcctacaggggtccagctattaaatctactctgtatagcctccatccagatggcattattttcaattgtttcctaaaattctgcacaacgtgcatcttccttttcatccctaccaccattgccttaattcagtctctcttattttctgtgcctattgacagaagcctcctcacttgtttccctgtctctagttttatccagccctcactccacccacattgcctacctgtcttccacactgacaacaaaatgccatgtccaaacccaaagccaattacatcatttcttacttaaaacctttgtatggctccagataacctggcactgaatttttttgtttcaactttatctccccatgatctactccacatactccatttcccgtttgcatctcttcttaaactcctgaagtcacactgcctcatgcctcctgtcttttcactggaatgctcttccatctcttacccacctggcttgcctttgttcatatttaaagactgtggagggtatctaaggcaggagttctcaaatgttttggtctcagagtcagagtctactcttaaatattattggggactgcaagatgacttgctcatgttatttatatctattaatatttaccgtgtagaaatttaaaatgagaacaatttttactatttacatgaaattcattttcaaataacagtaatatgtgctaaaatatataaaaatttttcatttaaaaatatattttcaaaaaattcatgaaaaactggcattgctttacatttttgcaaatttctctaacgtttggtttcataggatacagattttaatatctgcatctacattcaatctgtattgctatgttggtttggttgaagtatatgaagaaaatttggaataatctgtgggtattaattcaatctgcacaaaaattcaacaagtgataacctcttattagctgcaatatggagtctgaaactatactgatgaactttttgtattgtgttacattaaaacccattggtcaaccttaaatgagccttttatttatgtgtgatctctatagcatcatgtgtgggtcatttgaaaaacacccatttactgagccatgtagatcatccaaaaattgatacattgaccacacaatatcaaaaaaattacatttttcactgtcaccacaaatcttttcagtaaaggctttaagtattaggaaaccatcaaattcccagtggcagattccaaaattatgatttttgtgtgaaagctcaaattttatcatggccaacaaatagtgttagttgttttccttaaattaatatactttctttaggaatatgtctgcctaacacccagatctgaacagccatagtttttctatgtcattcttccaaataaaaagatttttctgtgaaaaaaggcagctagttcagcttgcaactaaattacacaactacttttcttcaaggcagcctttgtactttagtatgagcaaaaaaccttcatggcacaactactttgccccacagatgttaaaaaggtgttatacagggttgacatttaataaaagtaatattttttactgattattcgagagaattcttaaagagaactggcattgtttactgtgagtacacggtgttaaagaatacaatgactacttacataatttggtactgcttatcatgctctggcacctgtagttttacttaccattgtttttgcaccatcaatacaaatggtaacagagtgaaaaaaagaaaataatagcttaggtttattaagaaaagtgttttgacctcatgaaccccctaaaatggccttgagatcttcaggggctcagggactataccttgagaaccacttgtctgtgagtctaatcgtcccctctttgaggagttgccacctttccactcctttgatgaagctcctgtggaagctgcccatttctaagtaagcctgccccaccgctacttctgactgattggtctcagagagacccagtgaatcctttccccaggaaatttggccttagaactttgaaaagtggacagttcatcgaagcagcctcttttagtgtctgaggctatgagatataaagctttagaagtgtcagtgacaatacctcctgtcaaagtgaccaagagacagaggagaccatctgcactgagtgaaacagagatgagaaatggagagaaatcaaatgttaatgttcaaataaatggacccagattttccttaggtccagccatgttgccattcttgatgttaataccccagaatctctacaataaaagcccctctttatatattgtttatataaatttatatattgtttacataaattttctgttacttaaaattaaaagcatctggcaaaaaaaatcggctcaagagactcctcatctgtgaagactccttgacgccatcctctaagcagaattgataatgtcaaatcaattggtttgccaaaattaaagctagccctcatctttagtgtagcacctgcctcactgtaatctcactgtactgtaatggtttctcactagaatgttcccccaatacaccgcaagctccaagaaagcagtaaaagtataggactttttaaaaactcaaatcttagcaaattaaatatataaacggataagtagggaaaacgagacagagaaagaaggaaggaataaaaagagcacattcacacagacataaaatcttgttatattccttcctggctgagtcattttggctttctgaacctgcaccaacccacttgcaaaatacctaggcccctaggctgaagctgaaattcagacacttaaatgacttcactaagtaaaattttcctaagttatggaactttatccttgctggctcagtttgaaacactgatgttacggaaactatatttttggtcattcctctaggaatcatgaaaattgtgacatttataaaactttgtatttataaacaaaactgtataaattggaggcatccaactagaccccacccatcttccccatttaactacttagtcaagaaacttgaaaattaagtcccacaaaccacaaatataataaccaaatataaatgttataactctttgacaatcttttaatattcatttcctcatctgtaaaacagggaaaaatatccgacagagttgacataaaggttaaatgagacagtgtctttctagcaatgtactagcatggggtaagctaagtcgattattttacaagctttttcttctctctcagaaacattatgtactttaggcttcctctcaggaagttcggattgaaataacatttatagatgagctaagtcagaggattggcctaaattcacatagcttagtaactgccactgccgggggcccaacgcgggcttcctgactccacatcctgctcgtccattacacctgtggtctctcaccttcaggcaaagagtgctaagatttcagttcaagtattttattctacttttgggtatttaagcaaatgaattttgtaaagaattgagaaagaactgaaaataacagtgaacatttgaaggcattataagatgtgtaaaagtaatgacaagcaaatttgaaataacaagacatgaattttggttggtgactgccctgacgccagcttggcgagttgggtaagtcagttaagcaaaaggcacagcaattatgttatgtgcaaagcggaatttttttcttgtcctacaggaagagggaatgaattcattttctgagcacctatgttcaggcacttcacaagcattatattaattaattcttataacagtcctgctccgtgtgtattattatccctattttttctgacaagaaatctggggtctaataatttaatttgtccaggctcacagaattagtacctgcgattcccactaccctagactgttctacctgccttaaaagatcactgtgagataaaatgaaataagagatgagaacaaacatgtcacactgtccaaaatgtggtactactggtgaatagtcctcagctgcgaagtcagtaaacttgactttaaagttcttacctctccacttactattaataagtgtacaggtttgtcaacatcacttcacttctctgaacctcagttttctcaacaataaatggggcacaagattacaggcatcgatgcctgccttacagactgttaggagactccagcaagacagcaattgtaaaaaccctttgtgctctgtagagccctatacaaatgtgtgctattattattattgctattaccattattattacaccatgttctttgggcaagacatttatgttaaactgacacagcacataattggagtgctcaagttaaataaatgaagtcagctgtctgactcctttaagataaatgatgttattataacataattgtataaccccatatagcttacagcagcaaaaggatgtgtatttcacatgccctcctataattacatccccattataattttgcagttagttgcgatgagctctggtcatgaaaacatgccaattttgtatgggattgaagtctgcctaattttagcaaattgagagtcacacaaaagaaaagagataaatactatgttgttatttttcattagagaattgctatattaagaggctgcgatccagctgtgtttgtttaaataaaagtgtgatttgaatacctcctacagctaatgttcctgccaatgaataaaagataaaaatgcggctctcgttggatgggagtctctgcgttctagctgactcggagatttattgttccacataaggaagttgaaagcgtggagggcagaccacacgcagcggccttttgtgtattgtttcaagccgtatcactaatagatttcttccaccgaggctcccagcaattcagctgtgctcaaatgctccacttaactgtgaaaaaaaataataataaaatagtaattatgcctaaatggcaaatgcagcccagctcaatgccacaaggaagaaagtaaacaggaacaaatactattcagagaagaaatgctgtattttaatgctggtgataatggatttaagcctcatttttctttcaaagactcctctcactcatatcccagtgcctctctttcccctgtgtctcccctaaaaactagcaatattctcctgacattcattctcctcaagccagccacctcagaatgaaagaaatgtgatatccaggctatagtgcaattccaaagcgtgtggagtgatattctaggagcttggcataccaggatataagcagggttaaaatctccaccctcaagcagatcacagtctaatgatggatgtaagatatgcgttccccattctccaaactgctatctttttgaaaaatgtcattatctcactgcttgctcttgaccactcaattcctgccaaattccacttttcatcttaaagtagccatagcagacttcttatagacacacacacacacatacacacacgtgcgtggacacacagcatgctatctcttacctcaggcctttgcaagcactgcctaccttctctactgacttttcttccctcccttacccatgtagcagactcctactcattttcatgattcaattcaaacactgtttcccagaaatcttccctgctccacccacgggtgctccaaatgtgggatgagcagacctcctctctgttgcaaagacgcactgcataatctgtcttgctgatcctcagctcaggaggctggagtgggctggagagacatgcatcatgtgtttcccaaccccattctggagcacagggagcatatttcttcctttctctcttttatctccccaccaatctttatcatccaccagaatcacagccatcatgagcaactgtcactgataggagtgcattttcagatgagttagagctggaataaggagacctatagttgactgaaatgttctgtttgtttctctgtctccccattaagcctctgagggtggaaactgtatcatttcacccctacaacttcagggcccctaacactgactagaaatttatagatgtgtagtatgatggatggatggatgggtgaatggatggatggatgggtgaatagatgaatggataataaaacataatttaggaaaggagactggtgacatacgaaaagtgaaaacaactgcaatgagagccaaaatgagggacagttcatttacagagggaaaataatgaaggatccctacagaaagagtgaccgcagaggtaagacttaaaagatcttgtgattaggaacaaagcatcccaggcagagggtacaatgaaagtaacgactgaacaaacacacaagaacctacactatccaaagggtccagttactttagaaatcaacacttaattttttccagtaataaccaacctctgagaacttaagaaacaatcttcaagacctacctgcatagataatgaaaaaaaaatcagtttcagatggttttgtttcactgtttttgtaaaacccaactctggctaactagcttgattttccacctttctgttctttcaaaggctgaatacatatgattcacatctacagtatgtgctcagtatactgaatgaagtgactgaactaataaactcaaaattaccatcactggagacaataaaagtgtcacatcacttcatcagagtcaccacttcatggtgaagaagaattgcttggtttgaggttgggggagaagtcccccttattgactgcttaattctgtgcacattatttaatcttgctgagcttccatttcctcttctacaaatgacattaaaaacagttgcatctaaggctattgttgaaatcaaatgagacaactattaggttaaaccacatgaaattgccatttgataggtgaaagagcagcaattttatgtggttcaatctaatggaacagtgattagaatatgataaatgctcaatttatgttaacaataaatctttattgtgtatacatgataaatactagtttaaaccctatttatatcatttagaagcagttaatcaataagtcacttattgttctaactgaataataagtccctgcaaatacccaactatgtgttatgggaacagtttagaaaacattgtatcctattcatttcttaactttttctgttggcatctgtcaaggatattgaaaaggtatattcatgttcaaaagccttctttaattttcatcaccagttcactagtaacttattgttcatctgtaaaatgaagttgatgatatttgccttataggtatactgtaagggtaaaaagaaattcaaatttccaatgcaaagaaggtactcaacaaatagaatcctgtatgattgcaaaagaccaagatctataaaaagagtaaagtatttcacacacacaaaaaaatgacagggagaaagtttattcaagagcaggttacagccataggtattctggcctcgtgttaaagtatttttttaattgaaatcctatgaccttgcatgtaattctaaggaactggtgtgttggggctgacttagttaaggccaactggaggcctgagtggctgcttaccagaagccattgagtcttgaaggcccaggaatgtcagggagtctagtttatactgtctgagtcaatttaaataaccagaatgcctaaagtcttaaaaaatctattcaaacagtaactttcatgaccaaattaaaagtacatgttttttctctaaggatatggcatagggatcaaaactagatatgaaactactcagaaggatctgattaatagcagaggtttctgacctagaagtacatgaagaatgtgttcatttttaccatcagaaatgtttattatccttatcagcaataataataaactaagttacaacaacacactaaggtgctttgcagacatggtttttatcaagtgaaaaatactaatatccatccaattaagcaattcattttggttacattttggaatatctgaaagctagtatgtggggattgcaagaggatactgtcgggaatgttcacagggtgtacacaggggcatgctataacaatgttcagaatgcacacttggggacattagtctcacacactaaatttggagggcacatcctaatgtgatgctgaaaataatcaccgaatctcaaaacgcttcttcacttcgaagaatttagactaggaatgacgtgagatatcctaagggaatttcttggagattatcctttccagaaagggttggggggggaatcaaagcaaaagaaagaaggcattctaaactacagtgtgaggcatgcaaatgggaagagggaagagggttctctctcaaaactagcactgggatgtcatgcaggtttggcaccaagagacaatacggggtgacgactgacagtgcaggctcttggggtcatcttagtcgtgtccactgccagttccgccactctgagaccttggacaaatgatcttaccgctctgagctttcgttttttcatctgctgaggaggctagtaatctctgcctggtaggaagtaagcagcacagagcctcagagagtctttgggcaatacgtggggctagcgggggccttcagtttgctccacccctcaaggaagactttcagttggaaaggaacaaatgtcaggacccttccaaggtgtcaggtacccaggttcctttccagtggagctccatggttccaaagagaaagggaaggaacgctacatgggtagattcttgagattttgagcatgggagcaggctgagctcggaggagatgaatttgatctgggagtgatggtcagcttggaaagctcccagcccctggcctggcctggctgaggctgtggcactgagcagactaatcagctccaggctgtggtgtgattgctgcaatactgggggaaatgatagattttctcctatcggagtctgaaatcaatttagcatgagattttggtcatctgagaaagagtccaaatgagaaccaggaaaagttgaacatgaacatatcttttcaatatccttgacagatgccaacagagaaagttaagaaatgaataggatataatgttttctaaacttcccagaacacacagttgaggtattcacagggattctaccaaaaaaaaaaaaaaaaaaaagtgttctgtggtcacataagtctggaaactgctatacgctgtatttatattcatctaatacatgtaattatattcatatgatgcatatattaattatattcatctaatatttcccattagtaaatcaaatgctctgagaaagtctgtaataaaaaggtttttattttgttcaatcttgtgtttaacccctgtgttcgagtgtggttttattttgctttctttttagaacgcaatacctatgaacacctctcaaaacaccagtgctcttatgaagtcaagttgagaaggatagagactaaaaaatgatcatgttaattaactatttctatgtgcgtcttccagggttctaactaatccctcccaatgtgaagatgactcccatgaggcacccttctcattttcttcaccaggaagacttacctcttggaagccttctttgaattagttttcaccaccagttcaagttaggaggcttcccctgtactctcagagccctcaggtttagtacatgtgacaacatattcaaatcttttagagtctgttgtccctattaagctgtgaattccttaatgacacacttgtgtctgagatcccagcaactattcaaatacccaccaaacatctttcacatgattgttacaactttgctaagctaaacttcaaaggttgggcaaaaatctctatgctcagtgtgaaaggtccaaaggtaattgcttattcccatgttggctgcctgcacagaattagagaatcttacaagaaaaggaacctggaaacttagcttacttagcttgttgccttccaattgagagactcatccatgctgtattaacagccaacaagaaatttcattccgttaggttggtgcaaaagtaattgctgtttttgccattaaagattttatctcgacattaggttcgggatatatccaggctacttcatttccaccacctgtgttctggttccagcatttaatacctatcacgagtgacattacataggaatctacactgttctttcttccttcatccaccttacacaagatttgttactttccttatcaacaatgggtaccacttctattgcaaatcatgcaacgtattttcaccttgtaatattatataatatttcctgctccccaaaaattacttcatagaacctcatgccagcaaataaattccaaaatctcatatcctataattcagcatcatctaaaaactggtccatattttatattggttgcaaaactgatgttgatagttttggtgtttatgttattaaatcttctttgtctaaggactcaaataataaattttagcataatttagtttctgaatgtatttgctttattagatagcaatctaatgtgctttgattttttactaagctgctaaacaaattcaaatatattgcacaggtgttatatttgttgagctcagatatccagaagtatcaatttctgctacttcactcaaacatattcagttctgaaatatccctaaatgtctatcttaactgtatctttactaatcaattttactgatatgtaatttatatataataatatgcatccataagtgtacagtttgatgaggtttgacatatgtatacctcagatagccattgtagtaatgaagaaatataatgtatccctcaaaaatgtgccctcattccttttaatagtcaattccaccctccctttgtctttggcaactactgatcttatttctaccactatagattaatttgacttttctggaattttgtgtaaatgaaatattcgacatatactcttttgtgtctggcttttttcacttagaataatatttttgagattcattcatataatgcacttaaaagtatttcatccttttattaataattgctgggtagtgttccattgtgtgactatgtcaaaaaattgtttattccagccaggcgcggtggctcacacctgtaatcccagcactttgggaggctgaggcaggcagatcacaaggtcaggggatcgagaccatcctggctaacacggtgaaaccccgtctctactaaaaatacaaaaaatcagccaggtgtggtggcgggcacctgtagtcccagctagttgggaggctggggcaggagaatggcgtgaacccgggaggcggagcttgcagtgagctgagattgcgccactgcactccaacctgggcgacagagcaagacactgtctcagaaaacaaaaaaaatgtttattcagtgaatatatcaaaaaattgtttattcaatctcgcattgaagggaatttgggttgtttctacctgggaacaattatcattagacctgcaatgaacatttccttacacaatgtgtgaggacatgtgttttcatttttttatttcttttggttaaataattggaagtggaaatgctgggatctgtggttagtacatgttcaatttcataagaagctgccaaactgtttttcaaagtagttgttactttttacatatatatcagcaatgtataagatattcagttccaaattcttaccaacacatggttttgcagtcttttaaatgttaggcattctaatgaatatgtagtagtatcttgttttgattttaaattgtattttcctggtgattaatgatgttgatcatctttgtttattcttgttggcatttatatatctttcttgatgaacgcttcatgtacacttaaaacttttgcctatttttgagttgtctgtctctctattattgtagaagttcattatgtgttttgcatgcaagtcctttactggacatatttattattaatacttttcccaacttttacttgccttttcattttcttaggtgtcttcaaagagcactggtttttaattttgataaagattatgtcttttttcttttatggttttaaactttttgagtcctaatttaaaaatattttccacctcaaatttgcaaaaatgtcttctacattttcttctggaagttttaaagttttaactgctacatttaggtctatggtctactttcagttaatttttgtgtagtgtgttaggtaagagtcaaagctgttgtttctcccacaacatcctccagcaggttttgcagaaatgactctcatttctccaattgattgctttacaacttttgttacaaatgaattaatataaagggtacatctattcctggactctctactctgtttcactgatgtaattgctctccttacaagaatatcacactgtctagatcactgaagcttcataattagtcttgacataaggattgtgtatcttccaacatttttttttcaaaattgttttggctgttctaggcccctttgtattttcttgtaaatactagaatcttattatcaatttctctattttaaaaagcctgatgatattttggtcagtattaagttgaatctctagatcatttttgagagaaatggcttcttataaaactttaaagatgctgttttcctgtcttctcacttgcagtgtctctaatgagcaatatgctgtcatctttaacttttttcctctatatatatgttttttatctgattgctttaaatgtttctctttatcactggttttgagcaatttgattataatatatcttggagtaattttcttcatattttttgtacttgatatccatcgatcttcttgattctgtgtgtttataatattcatcaaattgaaaccattttggtgattatatcttcaaatataatcaaatgcaatcatattttgtctgtccttctcctctgttagtcttcaaggactccaactatatctatgttaggctacttgcagttgttccatgcttattttttttttcatttttaaaaactattttttctccctatgtttcattttttctagcttctattgctacatcttcaagttcactaaccttttgttctgcaatgtctcatctaccattaatcctctcaaatgtatttttcatatcacacattatagtttgcatctctaatagtttgatttgggcttttttatttcttccatgtctctgcttaacattttgaatgtatgaaatatatttaaaactgtattaatacatttgcctgctaattctacacctttgttaattctaggtcatatcaactgattgattttctttgcgtcattatgggccatctttttcttgttcatttcatgcctgatattttaaaatttaaaaccaaatattgtgaattttaccttgttttgtgttggatattttttgtatttctatcaacaatcatgagttttcttcttggatgcagttacagtcattggaaacaatttgatcctttcagacctggcctttgagatttgttaggtgggattggaacagtgctcaggatggggctgttcattccccaccactgagtcaaattctttggataatttacctaatttccagtgaatcatgagatttttccagtctgactggcagaaatagtcactttcttcagtcctatgtgagtgcaaggcactattccttctatccttttgggtatagttccccctaacctcaggtagatgccctatgaacattagttgcatactatgttgaatactcaagaggaatcttctgcaaatctctggagtttgctctctgtgcagctctctcctctctctcctctctgaccagcaaattccaggtacctttatatccctagactctaagctccatctcctcaactcaagggatccaacaggctccgtgaggattcctgttccctatgcaatggcctggaaactctctcaaggcagttagatgcaacaataatgaggttcacttaatttgcttcctgtctttcttaaaaatccttgggattttttctttttattttgaaggttttttgtttgtttctttctttctggtttgttctaggtgagagagtaaatctagtccctgttataacaccttgataagcagtggaagtctatctctgttcattagttaacctttttcctccctgcagttccacttgaatacttcaagtttgttcaccttccttctacattttccaatttactctttaattccatttcataaatttctttatttcagacattaccttttcaactcttgatgttttatttcattatttttatgtctatcatccatttcttcatgttattcatatttttaagtccttgagcatattttaacatttaacaatttaataataaaagctgttttaagattcatgtctgtcatttctggttctgttcctattgactaatttttcttctgattaccaaaacttgctctttcattgcatgcctagaatattttgtattggattctggattactgaatgtttggattttggtattatctttttatagatttgaaggctgttttggcttaaagtagttattgaaaatcactttaattctttcaaatcttattttaaatattgctagggataatgtacctcttactattactgttattctattagccttctgaggtctcggtctctagtgataattgtagtgtattcagcaaagtctttctactctagccaaacatcattcaaacatctcccagtccagtgtgagatcttgggattgtttaaatcacattttaatagtgtttgattttggtcaacattgtgaaacagtactctattcctgaatagattataatacagccaaagtctcaagggtacctgcatgcagttttctggaacttttctgtacatagctctctccaaacgactagcaaatttctgctactcctaccttcccaaactcatagccatgtatctccaactcagtgagaatgccatgctctgtgtgggagccttctccctgcactgcagtcctgaacgttcttccagaacaatgatagaactcaccttattgttccccttctctcagagattaccatcctgcaatacctgttgtccaatgtgtgaaaaattatgtcatgtattttgtccagttccctccttgttttttgtggaaaagcaaatctactctcagttactccaccacggtggattatggaagtcctcttgtgtttcctctcagcacttaaagatgttattccattatcgtccagtgtacatgggtcttgaatgctctgccataattcttattttttgttcctccctatgtaacatgactatttttctctgactaacttcagtattttcccattttcctttgttttcagcagtttgaatatgatatgccaaggtgttttcttttggggtgagaaattgttttgttttggttatcttgtttgttttaaggtgggggctggtttgtcagaaggtttgcttttcaatgtctacctcaccctcaaattttgattttctccatatgctgcaccttatatagagtctatctcttacatgtcacttgttacttagtgttttttagcctagcagtttggggtggtagtcatgctcttctattctggtaaactctcattctgaggcaagtattaggttcctgggtgtagatatgagcttaacacatatttctgatcctccatcctttgtgtttttatccatatgctaccaaaaatcttttcaagagaaaactagcattattagatcctagctacgtgaccttaagcaaaggcatcatttctctggacttcagttttttaaatgtaaagtgtagataataaaactaaagaaattaaatattataaaaataaaaatttaaaaagggcaggtgtggtggctcacacctgtaatctcaaagctttgggaggccaaggcaggaggattgcttgaggccaggagttcaagaccaacatgggaaacatgaaaagaccccatctctataaaaacatttttaattaacttattagacaattagctgggcatggtggcatgcacttatagttctagctacttgggaagtatattaatctgttctcatactgctatgaagaaatatctaagactgggtaatttgtaaagaaaaaggggtttaatggactcacagttccacaaggctggggagaaaggcctcacaatcatggcagaaggtgaaggaggagcaaaggcatgccttatggggcatcaggcaagaaagtatgttcaggggaactgccatttataaaaccatcagatctcatgagacatattcactatgatgagaacagcatgggaaaaacccacccctatgattcaattacctcccactgggtccctcccatgacttatggggattatgggagctacagttcaagatgagatttgggtggggacacagccaaatcatatcaggaagctaaggcaggaggatcacttcaccccaggaggttgaggctgcagtgaactatgatcatgccactgcactctggcctgggtgacggagaccctgtcttttaaaagaaaaagcaactatgtctgtgacatagtgttgtatacatattttatgattaacttattaataatagcatgagaatgaatgcattggagcttttattaaccaagcaaaagttacactttacacttaaaactcagcttgtgggaaaagaatctatttcatcagttactatccagaatgaagatgaagaataaatgtttatctctcagatatgaacatgtgtcagaacataaggagctgaaaacagaaacataccaggtaatggatgaagggaatagagtcaaggggagccctcagagaatgaagtaactttactaactgtaaatagcattcagtgaaattaagtaactagaagatgcagtgggatgacatgtcagactaagagcaccctcagaagtcaggcaatgctgagtttaaatccaagatcttctatttataagacatcataatttgggaaaactaatctctctaaaccttaatgtttttatctgcaacatggcgataatagtgtctctctcacagatttgttctaaggattaaatgaaataatatatgtgaaagagcctgagagataacaggagactctgtttgttcagaaaacacataaaggtgggccgagacccagccatcactggcagtcaagcatagacagaagcagcgtcatggacgctctgcctcagcaagtaaaaacaaacaaacaaacaaatagataaataaacagcacgtctactaaccaaagagaaagctatctacaaggaaacagtaacatgagccaaaggcaacacagagccaaaactcagaaatctaggagagagatgccaaaccggaagctcagatgccaagattaggtggcaagggtaaaagtcaggtagcaccacacaagtgtgcaggaacagaaatagccagatttgacgttaaacaagacagtgtgtttgaagcaggtggggtgggactctaaaaggaattccaatcaaagttacttctaaggagacttccaactttagaattttagaattccatggttttgcttaaatatttctcattactagctcccagttctagccttggaggcagcatgtgaattcctgtgtcttagcaaatgcttactggatagctctcagcatcatgactttggctaagttactggtaaaggacacttgacactcctttcatgacttatttttctatcccccttcctatgtttggagtgttccccatcttataaatattgaatggggcagagcctagttcttagcatagaagataaagaagttgatgctgcttaaggataaacagctaatgcatgtggggtttaatacctaggtgataggttgataggtgcagcaaaccaccatggcacatgattacttatgtaacaaacctgcacatcctgcacatgtatcccagaactttaaattaaattaaattaaattttaaaaaagaagtcgatgctgcttttgcaccctccacaacagacagggctcagccatttgaatctgctgatcagcagcatccaccatgggctttgagctgaaagctcataatccaaataagtaaggccatggagaatcctcttctgtagaagttaccattgcaagatagtgttcaaactttaatgttggcctccagcatccaccatgattgttagttctatggtggcagcatcacaactttctctctaacccagctttctgaggtagattttgggtagtgttttgccgagcaaatgccaaacctgattctccaatcaacctgataattattttaataaattctcttttttgaatcagacaaagtcagtttcttcagtgctgtgattacattactctttagaaccagttacctcatctataaaatggtagaatactaatttctgccaatagaaagctatgataatttacactgagaaaggcatataatatgtttaaagaagatcctgaaatacagttttctgtttgtcagtattagctgttattatttaggtttttgtgctttacagggaaatttgacaaatcttgttattgaaagctcacaataacttacaagatattaattgtactaatctgggaactcaggtccattaatattaagcatacagaatgaacaaaatgagaagtactgggaaaatttctaggcaaaactgccattaagatggcttatgaaacagtaggaatcattaaaaccagtgaaagaaactgaatgaaactgagaagagagtaccaaggtctcagtaactctaatgtttaaaggtttagtagagatgttagcaagaaacactgaaaagaaaaggacaaaaaattaggaaaaattgagattggccaaaaagccaaaagaaaaaatatatttccataatgaattggtcaattatacttcagcttccaattcttatccattttccttctaaaggaaaaagaactatgtagggctggaaggaatatgaataaaacaattgtgtgaaagaggaaaatgggctatgctgacaaagaaggcaactgacacctgtgtttggtagttcctaagcagagtatcccaccgttcaatataaagtacccaagaggtactttatattgggtacaatataaagtggagactgccccaggtatataagaaagaatcaatatcaagcaatatcatagctggggaggtagctacaggaatctccagagagagtactatatttgaagtcaaagtaaagaattattcagaatctggttactacgtctttcagaatatgatcctggtttatcatttttgggggtcaggaacaacatccaaactcaaaaatgcggccaaaaaggggatgtctggtcactaaccaaggaggctgagtgtcaagccaggactcacacatagcatgggcctggagcaaaaaggaggaaaccaacataagcacaccatcaaacacacagacaacaaacagctattagtacagggccaaggcatatagacaagttaggtaactgccagggcctcagtgagcacatattaccaagagccacccccaaccatgctataggagaggatttgtgggaacagaagagcaaggagaatgaggcttctgctgtgctcagagaaacctatttcatgaacctgcaggtgagcactttcagggatcccaactgatgaggtctggagagagggaaggaagaaggaaagggaagaagagggtaaggtaaagaaggacacttggagagtagaagaactggaagaagaacttggaaggaaaaaaggaaacaggaagaagaatttggaaggacaaaaggaaacaggtagagggatgaaggaggcaggtggaagtgagagagagaatgaaacagaaaattaggaagagaagatgtatatgttaaagcaggaagaacacgactaaatattacaggagagggtacaagaaaaaatgtttgaaatatgtgtaaactatagttcaattatttgagatcagccataacacggagaaaaaaatcacatcaggttttaaccgccataagtaccaaatagttatgcttcctgcatttataaacagatatcttttggcaagtgaatcaaaaaggcctctacaagacatgcaattctgggcttcaatccattcactctgtgaattaattgactttatttgaactctactgttttcagttggagaattcactgtgaacatgttgtacatatctcaaatatcaaatagcaaatgcactgcagccagattctgaaacagagccagaaattgtttattaatcagacaggggtttctccatgattaggaaagacaactaagggataaatacataaaataaacagctaaactctggaatgtcttccacatttctcctttcactttggaagcaaaagctccactggaaaccaagtaattgttctcactaggggcagggggtgatacatgacacctgctttcaaagcaacatttgcccctaaacctcatttccaatctgtttttcatatattactcaaaatagtaatttgccagcaatagattcataaatccagttgtctttcttctcttacaacaccaataatgttacattttaatcttttattgcaaataaaaagtttcttcgagctgacaggcccagaagtgaatattctggttaatgtctaaagctattacattaaaacgttaaagcatatagtgttctaagcaggatttatcagagctagcaaaagataaatactctgggtctcttaatcaaataaattggttacatagatagacagatagatagatagatagatagatagataatatagatagataatagacagatcacgctggataatagccatagccaaaggcaaaccacaggtctagtcttggccacctgccactgctactggaactgtgatgaatctgactccatgaatgtttcctctgtctctgttttacattctcagatccaagatcctctaattgttttttcatctccctttcatgaccaatccatggactaggcaacacagcacaggatcactgccttcagactagacaacacagcacagggtcaccacttggaagattccctaatggtaagggtccctacaaaaggaaggagaggtcagcaaataggaaatggttaagcctggattgcaaccccagaggctgtcctcatcactaataggtaatttgaaaatcacaagcaggagtccagatgtcaaccttcttctaggtacacattggtgactaaagtaacagagagtctcaaggaaatgttagttcatagggggaaatgatgagatattgagaaagatcaataaagggaaagaaatactaaaaactgaacaatgtatagcagtggcagcagaataaatgaagcaaacagaacaataattattaaaagtattattaaatatttatacagagaaagaaagagacattatagagagcataacagatgaacaaatcaggaataagcaaatatggaacataattatttggatttattggtaataagaacaccattactataataaaaaaattgataggctgaattacagaatatagtgccaaagttatttagtgggtcaaagatccacgtgaagaattatcactggaggtattaagaaagttcaaataagaacaataaataaaaagttttgtagaagagatatgtagaagggtcaatatttaatattaatcccaaatgacataagtagaagtaaaaaatgtatttgagggaatagtgaccaataatttgacaaaatgaaaagatttatgacacttcaaattcaaaaggatctagagttcagtacaggatagatttcttcaagccctacctctattaaaaagaatttttaaagctcccaagactcaaagataaatttttaaaatattaattccagaatattaaaacaattttctaaaatagtgaagaatcaaattaatatcaaattctaaatagctacactacgtatgaggagaaaatgacataaaatttttgttttgaaggaaaagaccttgagtcaacttgaatatctagttgaattataatttatatatgagagtaaacattacccaacttttgaactagtaaaaaaaaaaaatcttaataaagggaatcaaaataaagaaggagaagggagaggaaaattaagagaaaagaaagagaaaaaatacgtcaattgatatataaaaataacatagtaggaataagtactgatgctatttataattaaaatagattactccaaggatacatatttccataatagttttataaaaaattcagcaatgtcgaagataagagacttgaactgagaagaaactaaatgattgaaaataaacagatatgccaaacaaatactgaaaaacagaatgctagagcttcaactttcatatgaggcaaaacagaacttaaaaacaaacaagaacactatgagatataagtaataattcacagagtaggaatatgtaataaatcatgaacacatatgcacctaataacatattttcaggatatacaaagcaacaatttacatgatgatgcagcagataaaattaaaactttagctggaaatgttaatgtttttatcacagacactgaaaaaatgaagtagacaaaaatgtaaacattatagacaatttgaaacataaacaaagctttacactgattaaataaaggttatttttttttaaatgtgcttggaaagtttataaattcagccaaataataaagtctcagcaaaagcaaaaaacgtttattatgtaaactatgttatctaattgttatactataatatcataaataaattacaaaaggataattttgaaattccatatgtccaataattaaaataatactactaaatcacaggtaaaaattaagtcagaaaggaaattagtaaaatttagatctgaaagacaataaaaagccaaatgacaaaatttgtgagttacagctatagcaatatttaaaataaaaattataaatacatttattttaaaaataaggaagattaaaaactaatgaactaagaatttttaaaaatgtataagaggattaccaggagaggagccaagatggccgaatagcaacagctccggtctacagctcccagcgtgagcgacgcagaagacgggtgatttctgcatttccatctgaggtactgggttcatctcactagggagtgccagacagtgggcgcaggtcagtgggtgcgcgcaccgtgcacgagccgaagcagggcgaggcattgtctcacttgggaagcgcaaggggtcagggagttccctttccgagtcaaagaaaggggtgacggacgcacctggaaaatcgggtctctcccacccgaatattgcgctttcggaccggcttaaaaaacggcgcaccgcgagattatatcttgcacctggctaggagggtcctacgcccacggagtctcgctgattgctagcacagcagtctgagatcaaactgcaaggccgcagcaaggctgggggaggggcgcccgccattgcccaggcttgcttgggtaaacaaagcagccgggaagctagaactgggtggagcccaccacagctcaaggaggcctgcctgcctttgtaggctccacctctgggggcagggcacagacaaataaaaagacagcagtaacctctgcagacttaaatgtccctgtctgacagctttgaagagagcagtggttctcccagcatgcagttggagatctgagaacgggcagactgcctcctcaagtgggtccctgacccctgacccccgagcagcctaactgggaggcaccccccggcaggggcacactgacacctcacacggcagggtattccaacagacctgcagctgagggtcctgtctgttagaaggaaaactaacaaacagaaaggacatccacaccaaaaacccatctgtacatcaccatcatcaaagatcaaaagtagataaaaccacaaagatggggaaaaaacagaacagaaaaactggaaactgtaaaatgcatagtgcctctcctcctccaaaggaacacagttcctcaccagcaacggaacaaagctggatggagaatgactttgacgagctgagagaagaaggcttcagatgatcaaattactctgagctatgggaggacattcaaaccaaaggcaaagaagttgaaacctttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagacaaaagaataaaaagaaatgagcaaagcctccaagaaatatgggactatgtgaaaagaccaaatctatgtctgatcggtgtacctgaaagtgatggggacaatggaaccaagttggaaaacacgctgcaggatattatccaggagaacttccccaatctagcaaggaaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaaacccatcagactaacagcggatctctcagcagaaaccctacaagccagaagagagtgggggcaaatattcaacattcttaaagaaaagaattttcaacccagaatttcatatccagccaaactaagcttcataagtgaaggagaaataaaatcctttacagacaagaaatgctgagagattttgtcaccaccaggcctaccctaaaagagctcctgaaggaagcgccaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggattaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatgtaaaacaaaaaaaggcaggggttgcaatcctagtctctgataaaacagactttaaaccaacaaagatcaaaagagacaaagaaggccattacctaatggtaaagggatcaattcaacaagaagagctaactatcctaaatatatatgcacccaatacaggagcacccagattcataaagaaagtcatgagtgacctacaaagagacttagactcccacacattaataatgggagactttaacaccccactgtcaacattagacagatcaacaagacagaaagtcaacaaggatacccaggaattgaacctctgcaccaagcagacctaatagacatctacagaactctccaccccaaatcaacagaatctacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcattcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatggctacaagagaaagcaggaaagatccaaaattgacacccgaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagcttgttttttgaaaggatcaacaaaattgatagaccgctagcaagactaataaagaaaaaaagagagaagaatctaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagagtaaaccaggaagaagttgaatctctgaatagaccaaaaacaggatctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaatgaatccagcagcacatcaaaaagtttatccaccgtgattaagtgggcttcatccctgggatgcaagactggttcaatatgcacaaatcaataaatgtaatccagcatataaacagaaccaaagacaaaaaccacatgattgtctcaatagatgcagaaaaagcctttgacaaaattcaacaacacttcatgctaaaaactctcaataaattaggtattgatgggacgtatttcaaaataataagagctatctatgacaaacccacagccaatatcatactgaatggtcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagccgataagcaacttcagcaaagtctcaggatacaaaatcaatgtacaaaaatcacaagcattcttatacaccaacaacagacaaacagagagccaaatcatgaatgaactaccattcacaattgcttcaaagagaataaaatacctaggaatccaaattacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttacagattcaataccatccccataaagctaccaatgactttcttcacagaattggaaaaaactactttaaagttcatatggaaccaaaaaagggcccgcattgccaaggcaatccgaagccaaaagaacaaatctggaggcatcacactacctgacttcaaactatactacaaggctacagtaaccaaaacagcatggtattggtaccaaaacagagatatagatcaatggaacagaacagagccctcagaaataacgccgcatatctacaactatctgatctttgacaaacctgagaaaaatgagcaatggggaaaggattccctatttaataaatggtgctgggaaaactggctagccatatgtagaaagctgaaactggatcctttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaactttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggcgattcctcagggatctagaaccagaaataccatttgacccagccatcccattactgggtatatacccaaaggactctaaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcgtgtcctttgtagggacatggatgaaattggaaatcatcattcttagtaaactatcgcaagaacaaaaaaccaaacactgcatattctcactcataggtgggaattgaacaatgagatcacatggacacaggaaggggaatatcacactctggggactgtggtggggtggggggagaggggagggatagcattgggagatatacctaatgctagatgacgagttagtgagtgcagtgcaccagcatggcacatttatacatatgtaactaacctgcacaatgtgcacatgtaccctaaaacttaaagtataataaaaaaaaataaaaaaaataaaaataaaaaagaaaatatgggaaaggctaaaaaaaagaggattaccagagtaaacataaagaaaaaaaaatggaagtaagaacagaaataatacacaggaaagaaagaaaaaaaggaataaatacatatataacagaaatttttatgaaacaaccatacttctgaaatcctgtataaaactgatatatttttagaaaaatataaagtgccaagattggcacatgaaaaattaaaaaatttaaatagattggtaatcttttttaatgaaatggtaaccaaaaccttctgctattctaaaaattcacgaacctagacaattttccagataacacaataaaatagtattttaaagaaattttttaagatttcattttttaagaaataaatattctaatttaaacaagttgttttttaaaaaaattttaaaaggtggaagtaccctattcactttatttttaatatatacttgataccaaaaccagatggcaatgtgagaaaataaaaacataagccaattttaatttttaaaatagatgcaatattcacacaaatgttggcacaaaaatgtttatagcaactttattcataattgccaaaaccggaagcaaccaagatatccttcaataggtaaatggataaacatactattattacacactcatataatggaatgctagtcagtgatagaaaggaacagtttattaatccatacgacatcagtgactcttacatacatattcctaaatgaatgcagccagtatgtaagactccatactgcatgattccatttatataacattccagaaaaggcaaactgatgtataaagaaaacaaatcaatggataccaaggatttctggaagggaagagttgactaggggaagcacagggattttttagggcagtgaaactgtacagtatttaaccatagtggtggattcataccaccatatatttgctgaaaccccaaaatagattttaacagcccaaaaagtaagccttatttttaaaaaaaattaattaaagcattgggggaatcacaggatgaaattcagacaaagacaaaagtatataattgtactacagaggtatggcataacctctctgaagagagtggccaaataataataataataataataataataatgctgacctaagtaactttagaaatgactgggaagtataagactacaaacacaagcactgtcctttagttggccaagttgtttctcacagaaggatgggttaacaattctaaaactactgtacatatatactaggattaaacaaattagtacaacaatgttggatggcggaaccaggtttctcactgttggagagtgacataacaggctagcataggcagaagactataatgaatcatgtgggctgggttagggttggaaatatcactataagctcatatttagcttaatactaatacagatagaaataattatagagatagaaatacacacacatgtacacacgcatacacacacagcttaatatacatacatgtattttttaactgtctgtggaaagggcctggaagcaattatacccagtagcaatgatcatatccagttctcagattttggtttctatcatcatcctccaataaaaggaactagggatctgtactagtctatttgtattgctataaaggaatacctgagctgggtaatctataaagaaaagagttttttttggctcacagttctgcaggctgtacaagcatggcactagcgttgcttctgctgaagccctcaggaaacttccactcatggcagaaggcaaagggagcaggcatgccacatggtaagagagggaacaacagagattcgaggctctttcaaacaatcagctgtctcatgaactaatagggtgagaactcattaatgcagggaggacgcttcatgagggatctggccccgtgactcagacaccttccactaggcctcacctccaacactggggattgtatttcaatgtaagatttggaggggacaaggatccaaaccatacatgtaaccttgagaaaatggctgattctaggactacagtagagaatatacaagatacatctgaagcatcgtatagtaccagaaagtcacacacaatgataggagtatgtcaaaaggacataagagcccattaaaagagcttgcaaagatcaaagttggaataatttgagcaacaacacaaataaaagagtactggattataagccaaactataaactagaaatttatggatccataacaatatacataagaatcaaataaagaaatgagggagaagagacaaatctaccatacaaaggaattccaaataatgtatgtagatactgcctattaaggaaatggagacggactccccaccccttgagtgtggactgtgcttagtgacttgattccaaagagtatggtatgaaaaggagggaagagaaaataattttttagtgcagaagcttggcaaatactacctcagccgggtgagcaaggttaatatcatcagctatgtcatgttgatagtatatacgcttaatataaggggataagaatgacacttcacctctttggtcttcctcctaaaaaatcataagcccaatctaaccatgagaaaacaccagatgattggtatcacattccataaaatacctgaccaatattcctcataacaatcaacgtcatcaaaaacaagttatgtcatagtccaggagaaattaaggagacatgaaaactaaatagaatgtggaattatgagtgggattctagaacaataaaaggatattaagaaaaactaatgaaatgcaaatatagtatggagtttagttaacagcaatgtgtcaatatgggttcattagttgtgacaaaagcgccctactaatgtaagctattgacaatgggaaagattgggtgtggtgtgtacaggcgctctctgtactttctgtgcaagtcttctgtaaatacaaaactattctaagataaaatacttatttaaatatagattttaaaaatctaaaataaaatattggctaccaaatcttaaagcataatacaaaataatcatcatgattcctgacctatcaaaaaaattgattaataattttataacattaaaagaccatcgagaaaaatcttaagatacagatgttgatatttatagcagcactacctgtcatagccaggagctgaagacaacctaggtgttcaatattgagataatgaatagatataaagtggcctcgcatagaatgaaatattacacaacatttagaaataatgaacctagatgcatattgaaaaaggcataggtttaaaaaaattcagtcttcaatgaaaaaagtaaacaaaattatatttactctttatacatctatttatttaaaaacataaacaataggtacattttcaatggtttacaagcactctatgccccaggtactaatcaattttatactatatatatatatatatatatattaatctatttaattcagtgaataatcatacacagattaagaaactgaggtacagagaagctaaacagcttgcctcaggtcacacaatgcagtctggcagggtgaggagttgagcctggtctcctaaacctgcattcttaaacagcgtgctctaccacctcttctgtgacaggtggtttagagggcacatatcaaatataccattgtggtggtaattgaggagggggaagagatggtaaaggtggagagaaagaacaaaaagagcaagtagtaaaatatagcaaaacctaaagggcacctacgaagactgatgatgagagtgaactagactgaggagcatgattactttaaatcatacatctgatgtttgaaaaatataaagtgctgacattagccagaaatgtctgattactcttcaatcttagataaccaaacattttagatacatgactttttactaaatcagcacctttttaggccagaaatgtctagcctagcagactcatgagtatttgcctgaaggacctgaagacaactcccagatccctcagctctgaagacctactcatcccttgcttagactgttgccccaaaccacatatttctgatttgtgcttgaagttattgactggactttctcccaatgcctgaggccagtttaccatccagcacccactcctcacctagtgaaaatgcctatttatttttcttttactcttttttgcccctcggtcctggcatttagaccctatatcacacacagttggcctcatgtctatcctgtatctgtccatccatctgcccaagcatgtattcattcaacagacactgagtctttgccatgtgctatgcactgcaccggcaaccaagggcaccaatcgtgacaacaaaaatctcacagttcaaaaaggaagacacaattttaaaaataaatgaatgcaataaaatgaaatttaattaactggattatcaccagtattaataaaataacgtatataaatagcttaacatgtttgtaaaaagtcctgtagtcaatttttaatagctacatcaacgtgcacagagcttcccagaggagggcatccacttaaatgtgggccattcatttattcattcagtaaagtcaggcactgtgaaaggtgtttgtgtagagtcagctaactgagcacctaaaagctgcactcctgtttccaaagtattgaaacagctttcaatgagaagtggttggccaacctgagatcatatttaccatcatctcttgctttcagatgaggccatgaatatttgtttgagcgatcttagccactgtagcaaggccattccaacattttgttgacaaacacaataaaagtttattccagttcacctgcagtaaaatgcaggtagtcttgataaatgaggaaggaagcattctatacagtcattcagaaccccaggttcctttatttaggggttcttccatgtcccagggccttccgctgtaagcaaataagagggtaaaaaactatacccacttttaaccattttggctcaggtgtgacgtacatcactttcattcacttgttgttagtgagtacttgtaatatggtttctgcgttacacaagaggggattttgtagtacctgcctggacagctgctttccaaagacaactccacatagttaaaaaaaaaaacatgaatttttaaagatatgtgaccagttctcagcaatgaaatgcaagaagtacagagcatcacttatgaaaatggcagccagtgtgccatttccccccttttctctttgttctagagaaggttcctcaagaatcattgagcaaaaaattggagccctgatcgccaaatcaccacatggaaaaaaatcctaccacctacaggaatgcttccttggactatattcagatcgagagacaagtttctcctaagcttatctactaatgtattggcatttgtttgttactgcaactagaattgccctaattaataaactattacaactcattaataaaaactctataaatagtaactcaatagatgactccacaccttgcatggcccagagttggagtgcaataaatattttatacttgcctgtttgcaatttctttaatgtctttttgagaatgcggtagcctctttctggttaaattactctccacacatttttttctcccaagaccctcaggatgtcgactgcggccctgccgctgctcatactaatgtgaaaagaacaactttatgatacccattcagtgtcaggggtattaaaacaaaacaaaaaacctgatactttctctacagcacacttccctacttgcctacacatttttgagaccttttcttctctcactcttctttacggtatgaaaagatagcctgctctcgaatcacatcaatttgaattaatctacacagctgtcttctttaaatgaagtacaaatgtttaccattgtaaaaggcatgaattattaaaactttaagaacaaacctaatatgatttgaagcttccagaaaggcaaaagaggtcagatgtcatccgtatttagtctgcttgggctgccataacaaaatactacagactgggtggcttaaacgacagaaatttatttctcactgttttggaggctggaagtccaagaccaaagtccctgcaggtttggtttcttctgaggcttctctcattgggtggcagatggtcactctcttgctgcctctttgcatgatcttacctctgtgcacgcccatgcctcatgtcttcctcttcttataatgacaccagttctattcaattagggcccttcccttataacaacattttaccttaattacctctttaggtgctctatctccaaatacagtcaggttgggagttagagcttcaccatataaattttgagaagacttaattcaggccataacaccatactcagaggcaccttctcttcattcccaaagagctcatcgctgtatgtgtcacaaacttgaggaaagacttatatagtctctaccacaaagaccagggcaattgttgaagaagtttcatttgcccccatctcctgctgaattaagaatggtctagagttctctgagttcattccttaatttactcactagcagaaaacagaagctaaaatagtgtttcaatggcaacggcattaatattgaagtttgacctgcatttgaatgctaactctgatacttgtcacctatatggccttgggccaatcatttcatgtattggaacttcaagttattcagccttaaaatggtaaaaataatgtctactttacaggattaaagtattttaaaatatgtaaaccacgtggtgtattagtttcctattgccagccaatattaccataaacttagtggcttgaactaacacacatttattctcttctagttctggaagtcaaaagtctgtgaggagtcttatgggactaaaattaaggtgttgccaggactggttccttttagaggctccaggaaataatccattccttgccttagctactttctagaagctgccaccattccttgggtcatggcctcttccttcaacttcaaagccatcagagcaacatcttctctcctttctgacttcctgccttcatcttataaggacgcttataattacattgtgccaacctataatccaggaaaatctccccatctcaagatccatattttaatggcatccgtgcagttccttttgccacacaaggtacatatccacaggttctgggaattacaacacgatcatctttgtgagccattactcagcctatcacacatgacttactgtaaatcagggtagacatctgctggttatgcctgcagagtatctcctggaggaaaaatatttcttgcctgcggagtaatttcttccaattgaaatgttgcggattgggttacagttcccaattcctcattctctcctgatatagaattagtatgcataaccttttccatgtgtctagagtagaggaagaatattccccagactactgatgcttgacttggccatgtgatttgctttggccaatggaatgtttggccaatagatatgatgtgagcagaagtgaagctttaaatgtccttgcttggcttggcttttgtcttgagaaaaggatgggctgcacaacgcctggtcccagagcaaaagacatgtggaacaggcttatactcaacccatactctgaagcagagcttccctagccaacctcttagcggaaataagatgtttattccagtaagtgccttagatatttatgtcttttatttagctctagtgcagcaataactgactaattaaggtacccaacttttccttggagaaatctctcagattaggttccccagaagcagaccctgtaacaaggactcatgggaaagtgatttatttagaattattcccaagaaaaccggtaagggtgtggttaagtgcaactagaaaatatttagtatcataaacccaagtagatgactttagctcaattccacagagaagctctagaaacagtatagaacacacctgagagagatgtttccaccaagagaaaggagctagagtattcataccccacccttaccactcctaagggccgcctttagggacacataaattctctgctctccatgggcacaggcaaagcaggttctgacaacctgagggcagctgcctgacaaaaagatatagggaaatgttgctgagatcctaggaagtatgggcagaacactgagagtatctgctacaccacccctcccaactctccatccatgaattctgttcaagtggattctgctcccaaatccaggctaggcatgtgacccaagcctgacccatcagtgtattctatcaccctagcttcagcagtagatccaggatgagcacataattcaactaagtctaatcagagaatgtcttgggaaatttcatgaattgactagaaaaggggtactatccttatgttgatgtttctgagaaaatgggggtataagtcaactttcctgaaaatggggacaaccagaaacaaagcagagaagtcacaggaatgagccatccaataactctgatttgagccttttttgggttcagccatacctagctcctactctagacattgcagttaagtcaccacttaactgactaattgactgttttactcaaaacaactagaaagatcaaatgtagcccaatatcactttatgtaagatccctgtacatacctttatttctgtttgtggaaactgtaatcattctccaagtcactgctcaaattattccaccttctctgggtcccagtttcttcaactatgtcccccagaaagtggttggaaaaaaattaaacagcatgtacatgagaatctgtccagcccccatgtctgtgatgcactaggtgcttaataaatacttttaaatcaattttgtagattatcaaaaccaacttaagcatagctataagataagctttgtagttagttcccatattattctattaaacaaggtctttctacatcagtgatcttgtttttttttaaccttttcattacctacatttgcagagatgaggaaaatcagtgtcattcctctaacccagtataactccaaggttacccctgggattgtgggggaacttactgagaagcagagaaagataagtgtgtttactgggtacttattatgtgccaagcacaatgctcagttttacagagatgttaattcatttaataatcaaaaccatctttacgaagggacgttattgttcttgtttatcagatgagaaaactaagactcagaaacattaagtaacttatccaacattattcaacaaaagagaaagagaatattactgcagagagtacatggacatttagggatgaagggaactaaaatcgtatcaattactagctacatgaacttgaaccagtaacctcacagctttgtaggaattgacagagataatgtctattaagcccggctcatggtagatatgaattaaataatgatcctgccttctcctaagcagcaatggaactgtgacttgaccccacttctgtctaatgccaaaatccatctttgcccctcctagcctccctgcaatagaaagctgcaaatgtggagcatgagtctttgcatagtgcagagctggaaaaggattatcatccaccaccaccttagaaattgagtattgaagtattgattgacttttatttaatatgaatttctaaaaaacctctcatctactaaaggttcctttgaaattattagcctacagacatttatggttacatggcatatgcagctctaatataaacagatcaacccctctcactcttattttacactgcatcaggcactgaaaactaagtctgatgtaatagatctcttttgtagttttaatcataacaattgtaccaaatgacttttttgtgcatgtgataacatcataatggaaaaccaaatcgatagcatagttctcaatctaattatatgccttgcatttctaacccagctttaatgaaatacaataagtggtagtgtggaaattagaagaggctggaaaaaaagcagttgcaaataatactgtcagtgacaagaatagaagtatgacgatgctggtctgtgtgaacaatgcctcccattgtgactatgcaataaaaagctcccccaccacccaaaaaatgaggagggggtttatccaaacaaatcatcattttcagcaacaagcactttttacaaaacaagcctaggctacagcaattcaaaaatgtttaaggagcctcagaggttgcaaaacttatctacatgcaaacctcccctttttcacttcttaggccaccatctgatacacacaatagcaccttaatataacttttaaatagctactttccttatttagaaaagtaatcatgcttattatagaaaatctggaaaacactggaagagacatagaaaaaagtacaataacccaaaatctcacagtcagagataagcataattcacatttttctatatttccttcatttttttctaagaatatgttacatatttgaaatgatataataatcttattgaaagcatagtcagatatttcaaagtaatgaagttgatagctcacagacagataggccctaatataaaaataagttacttttatagttgctgtgttagtttattagggctgcctaccagagtaccacaaactgcatggctcaagcagcagaaatttattttctcacagttctggaggctggaagttcaagatcaaggtgtagcagagctggcttcttctgaggcccctctatcggctcatagatggctgtcttctcccggtatcttcatgtagtcttccttctgtgcatggctgtgtgtaaattttttcttcttatgagatcagttgtattggcttagggccctccctaattacatgactttaacatagtcacctgtttaaaaatatctccaaatacagtcacattctgaggtactagggtttaaaactttcaacatatgaagttggtttgggggaagcataattcttcccatgacaagtgctaagtgtggcaacacaaatatgccatacaccatacttcataacacaaatacaccatacacccaaaaagaacctaagtacatcatatagcatcatatacccacaagtatctctaggttttgcagcaggcactggagacataaagattgataaactagagcccctgtcaggaaaagacttaaatcagtggtccgaggaaggaccacttatttaataagtggcattagggaagttattaacaccctggggaaaatgtgcaaaggctcaatttataccatataccaaaataagttcacactttaaaatgagaaatgttaagacaaggaagaggaatcaaaggaggaggaagaaggagaggagaagaaaagcaaggaaaaaaagaaggagtaacaagggaaaagaggaaggtggagaagaaagaaaaagtagaaaacagaaatgtgttttattcgtcttacctatgaatggagtagacattttgtttgtaattatttaattatttcatttaataaatactatttgaccaacaaacacagaccaggtgttctgctaggcacagaatgaaccaggttttttgatgcttctacacaatggaaggagccccttgggttgtgtattatgtaaacagaagtttacatttcttgcctggcatattcagtattggccacctctccctataccaacatcatgagctgtatgcagtcaatatgttcccgcataagttattttcaaagcataattttaaatcagatcccattaaaaatgcaagaagagggcttgttgttaaaggagccctaggggaaccctgtggtaagaagaagcatccttatgtaaaagcaagaccgctgctctgtggttcccacactgtgtcaaacccgactgtcatacctgtgtcctggcttgcaggttatgcctgagcgctcatgtgtgtttgcactgtctgtccttctgccttggattgcaaacccctggaggttggcccatcacatctgttcccttcattgtgcccagtgtcacaatgaagcgttttcaaagagatcctagtaaatgcttttgtgtgctgataatgatgcagcaaaggaaattagcaggcaatgtctgtggggctatattgaggaggtgccctatgtgtgttacttctaaatactaagactccatatcatatcactgctttgccaactgcagggagcaaatccccaggatccttcagtcctatttgtgttcccagcaacagagaagagaggagaaataatttaagggaatgacagaagagactgagagttggcgattccttgggacactccaagaagctcagtcggagcaggattgaggtgcttacctccaaatgcctttgaagaagacaggcttttctgtatgcttccagatcacggagtgagattgctgttcttcccattgggaacggtctcatgtcagtagcacatcgcattgcagcttactctcagaatcaaactatctacccagaagaaatggataaatccttgcaattctcttgggttcagaaaaagattttagccagaagctccttttctagtaagtagttgtatagtgttattgcccagtaaatgagtggtacaatttctggctgacaattgctgaattcaatcaaaatgtagtgacccagaaattgtcttaactcaatgctcataaatacaaacattgccccagaattataccagtattggtgaattttcctgaatgaaaaagacattatttctctgggagaattaagccattttaattcttggaccaattttctatttagtagtattttaatcatctttatttctatcttactaaaattatttttcatgaatatccactgttttccatgtacatttatttttgatacagctttcattcattttttttgcccacatcaaattaaatgagaaaagtttctgtctttgtaagttttctctgggggccattatttccacaaagtctattttttttttttttttttttttgagatagagtcttactctgttgcccaggctggagtgcagtggtgcgatcttggctcactgcaacttatgccttccgggttcaagcaattctcctgtctcagccccccaagtagctgggattacaggcacgtgccaccatgctcagctaatttttgtatttttagtagagatgaggtttcacgatattggtcgggctggtctcgaactcctgactcaggtgatctgtccgccttggcctcccaaagtgctgggattacaggcgtgagccactgcacctgggccagtctaattttttaattcgattttgcatttataaatttttccaaaatgatctttttcactatcaatattttaccaataattttttttaccatgtcatgctctagcctttgatggttttgttgggttatttctccagaaactactatttccctagttgatttttacatttttcaactttaccaatttttttcacctctaatacatttaataatggaaagttatagccattcccaattttctgttattttatttcaattaataatacctcatgtgaatttgatgtaaaataatgtatttttattcatttatgaaagcaaatcagaaacagaaggagtcaaaatatctgtaaagttaaagtattacagtgtggcaaaaacttgctgcttcattcaaatacaaacatccccggaaaggtaagccattatttaaatttgaatatgggaacagtgatttacatcatatgctttcctaagagatgaaaatagaagtatttggccaggtgcggtggctcacacctgtaatcccagcactttgggaggccgaggcaggcggatcacgaggtcaggagtttgaaaccagtatggccaacatagggaaaccccgtctctactaaaaaatacaaaaaattagccagacgtggtggtgcgcacctgtaatcccggctactcgggaggctgaggcaggagaatctgtgaacctgggaggcagaggttgcagttagctgagattgcgccattgcactccagcccgggcaacagtgtgagactccatctcaaaaaaaaaaaaaaaaaaaaaagaatagaaaatagaagtattcatttcccagctacctggcacatgacctggtgtccattcgtccctttccccttcttgaggctttgactctacagctggaaaaacaaagtagaaatgggggaaaaactgttttgttgtggcatagttgtggcacaagaacgtacagagcctggaacacttgagggccttaaagtcatcttaagggatttggaccttctcctggaggaactggaagccatgtaggcctctatttgaggatagatgctcagatttgagatttcaaaacatgactctggtaactgcatagaaaagagattgaagatggaaagtcaggaaacaggcttctgcagggctgactccagaccacagttttgcatcttcccaatctaaggcagttgatgccaggctggtatcccggcctttatgatataacccttggcaatctttgcatctgcccagtatccccaccctacttcaccagactcctctttgttctccaaaattttccatacctccatgcttccatgacctaagaaatttcttatttccattatctacctgaggagctcctacacattattatttcaaagttaaataaacattaataactataatcataataatgagcatttactgagaatgtgctttacaccattcaatgctattaatctcaccagataacaaaactgagctctagacagtttaactagcttgttcaaggttgcccaactagtgagcagggaggcctctatttcaaaagttcagcttgatgtcagagtttggatgttcctaatccacaccatgctgttccaccaggaaacatctgagtgcttaccatatgacataaattttcacacatattctcatatttaatcccaatggccagatagtgaggtaggtgtcatcattttaatacagagaaaactgagtcttggtgagtttaagtaacttcctccagagcaacagacactactggtctgtctaactacaaagacattatacttcccggtaagtgcctggctcatagatggttattgacacatattggtcccttcccttccacctgctctgccatgtccatacccagatcatgctgatcacccaaaagtgtatctgatcttacgacaccttcatccaaaaccagctagtgcctattcctatggaggatccagcttacctgttaatggaggtacccattgctgtaccttctcacccatatcctcttcccagtgaagctgttcagctcacagcccctgctgctgacatctccatgttttatattcaatgattctgctcttccactatagctgattggacctaaaagcagacaatcagacatcctttctcggaatgttgaaataaggaatgctaagaacttaagataatgttaggaatggcagcttccaaggtagagtctggctcagaataatcaggaagagccaagggcaagccaaagatgcttcaagcagaaacaaagacgatgcgaaatccaggtggtagcaaaagaagaatagagtagatgtgcttatggctaaagcaaacgctgagagggtagtgggacactgaggcccatgagggagaagcggggaatcattagagctgcctcacttcccaacaacttctcagtttccattcaagtgtttccctaaagaaaacctcctttttttctctggtaatgaaggtgacacattgtttcttaccacccaaagagcaaaacttaaaaaaacaaatagcctcctcctgccactcaatcttgagggtttcctgttaaaaacctttgagtctctaaatccaagactaagatgggaaaaagtcaaatgatgagatttaaagcctaatgtccttaagctaagcccccaccccagatgccaacccacccagatctgctcccactccctctgtatcccctctttggggtctcctctgcctgcccctggagttcatttcaatcactttggagcccaggatggctgggctatgggaaatcttccctctgtctagaactcctgccatttatctgatctgacctctccagacatttaaggtctgcagatcagaaatggatttttgttattgttcactgctattacaaatacaactcatcttcaacacctctctccacataaggcctgttatcctgctttcagagcaagccacaagaaagaaatggtgtcttgatttacttttcctggatatttcaagtccattttgtgcagcaaccacacataccacctattactaatgagatttaaaaggtgaagtccagggtgctggctgtttcccagctagtacgcatgcagctggtactacccagccccctggcaacaacccggaagccaaattccggggtacctgaagtcagatctctagatacctgaagcaagatccctggcagcacctaagatgtgagtcacattgcagaggttgagcctgcagctctctttgcatgtatgtgtgcagtctgcagccctgccaggcaatcacaggagccactcacaggtgtcacactgaatttcaggactccatggtgtttcctgcctcagcagcaacatcaaagctcagagcagtagctgttgtgttgacataggcagtagaaacaggtggagtaccatgacaacttggcccttgccactgaacctctacatttattttcaaaccatatccctcaacaatcctgtagtcatgaaaagcttcgcttggcaaaggtaagaatgtgagcacatttggacccaattcccctgacaaagggttcccattcacaatttggaagaaaatattcagtgtggctgtgacaccagccaaaatgagaaagcctggtgctggcaactcaccattttccaaatcgctgtgattctgcctcagtttgagcttcctggaaaataagggagagggtcatgtagaaaggactactcagcaaaagtgccttattatctcttgctgtatggcgctcactgctcttctccaatgcacagacacactcacaggtgtacacacgtatgctcatatctggaatgtgactgaagcacatgcagaatgggccgccacgatgcagcccgaggggcatctcagagaccttcactcaaagctgtctcctccactagggagcctcttctacctcaacttcctatcaattctagttccagctccgccttgggagtttagtacttctgcaagagactaaacttctctctggaaaaggtaatgcagaagtcccctagtagtctctttgggaatgaatttatcaaacctttcgctcattaagagtacttggattaaatagctatgcatgccgggcttaatagttaggtgatgagttgataggtgcagcaaaccaccatgacacatgtttacctatgtaataaacctgcacatcctgcacatgtacctcagaacttaaaataaaaataaatttttttaaaaaaagaatacttggatttgtgagtgggtgagtgaggaaaggcaatgaggaagagagaaaatgagttcttattaataataaattttgttctttttttctataacaaatgtattaccttcataatttgaagaaaaatataaattgtattaaaatttgttcaacccattatccccataactgtactcgtttttgtcaggtagctcaaatatccctatttagataggctaacatatccttagcctaacataaggcttgacatcttaggctggattcccttgaaaatagatcctggggcaaaagagatctctctctctcaagtttataggatcaaatcaggtaatgttggtaaaatcacgaagcttagtcccagataatagatgtccaagaaatggtggtgatagtggtagcaaaggaggaggtgatgtaatgatgtttgtagtaatcatcatggatataattaccattgaaatgttattgttagaatttattttatcacgttttgatcaatatatgtcagaatgttagatttaaagcaatctattttactctcttcagtcatttccaatataaacaactatctcatctccccgatgtagagttctcctagctcaatttccctttaggaaaaacatccaatactggaaatatttggtaataatagcaggttcttgtttcttttcctctgcatcttgttatgtttggcatgtcccattctctcattccctcagttgggaagagttgcatctatctcttatcccagtcctgggtggttttgattatgtagccataaacttaagccaatgagaagcagggaaattaatcagagcagcaggagttggtcttttctccaggatggagccagttcagcaaattactaagtcattttatgtagtcattctatacagactgagcaccttatgtgtgccaagccacacgctgagcactggggatggggaaatgaggaaggcatgtgcaggccatgtagtaggggtgtcatgaaggcctgtgtaaacaaacaggggtagggaagagtctcaaaggtggagaaaagattcagggccttttaggaagggatgcatcattgtcatagaagggtctcactgtgaatcaaagaggtctgtctgaatctagctccataagaagaggggatggcaggatctgatggcatcagatcccaactaatcttcttgaaatgcagggttaagcactaaatttaagtgtacttgagaactaaaatccttagtcaggccacaggtgatgagggcgaggcagggaggccatagtctgggacttatgagggtaacctgggtgctaaactcatctaagtcttaactaaactttggtttggaaataatacactttatacagacctcctcgttccattcctctgcaaagtcatgttcttggtgagtagattagtttgcagttgccagaccaccgtattccttatatctttatgagagttaacccactgctaagtatttctatggtactcctggccccataacctctaaatttatactctctcttcttcttttttttttttttgttgtggttgttgttgttgttttgttttgttttgttttgtttgagacagagtctcactctgtcgcccagggtggagtgcagtggcacgatctcagctcactgcaagctccgcctcctgggttcacgccattctcctgcctcagcctcctgcgtagctggtactacaggtgcccaccaccacacccggctaattttttttttttttatttctggtagagatgcactttctcttcttattctcctgacatccatgattctggaggaagtacattgtcaggggaaaatattggcatccatttcggttaggaatgattttccttcaatcaagaagttcagaggttggcatccagggctgccaaggctgttctatgtcttatcaagaactcaagccccctccatcattctctgttattctgagtggagtaatgcaaacacttcatgatgattaggctgtaaaaactgcctgtcactgcttaataatgcttgcttcattttacactactcctgaaatatcagcaatgagagactaatttttgccaatctccctagaaatgcataccctccctgtgaaagtaaagcagaaaatagtagtttactccttaatacaaattgatttcaaaagatcattcctgtctggtaaaatgttggatttttcaatggcacaggaaggaatataggaccatttggggatggagagcactagggaaattaggtgtgttagagaagagagtatttgtatggatacgaagatggacaagcctctgttaactgcagtgtggaggagagagtgctggatagctgggatactacctcattcttatggaaccatttttcttctagtgccttgaagattgccatagtacatcaggattcaacatttctaacgacacaatcagcatcctgaatatttgcttttctgtatatatctaatcattacaaacacaaaaaattaatactgtatgagtcgaggtaatgctatccaaactcaaaatatatgaaaactcaaatcccataaacatttctccttcaagggtagttctcaacaggtaatcgtgattggtgatggctttcttccacaggatcattcaggggcccaggttccttccatctcatcgcttccctaccttcaatatgtggctttcaaagtcactgtacttgcttccacaagtcagaggcaggaggaaagagcatggaagatcgcacatgggaggttttaaagagtaaggcttgggggtggctcatcttactgcccctcacatcccattggctagaactccatcaaatggccatacttagctgccagtgagactaggaagtgtagcctggctcatggtgttgataaagaggaaatgggtttggtgaagattattccatctctgtcacaaataccttctgctttccaagcacgagaccattcctttaaaaagagcagctaacacaaacatggcctcccctcagggagcctgaagtatagagaagaataaagaagttcaatcaataatcacaaacacatgtacaaatacatattcaaacaatacaattcaaacaatgcaattgcaaatgtgatgggaagatagagtgtgagaagaaaatgtaatgagtattatgacatagattataaggggctaagatgtataggaataagttagaattaactaagttgagcattaaggtgagcattccaaagtagagtgatatcgtatatcaggattatttgttccatttattcatctaccaagttaggtgcccacattgtgctaagtattcttccagtctccatggaagattccaaaatgcagagcacaaactcctgctgtctactgggaatactttgtggaatttattctgattcatcaggaacaagtgcacacaaactcacaaataatcttacatatttgagatgatttcaagtgtggaaaaggacaattataccactgagtggttttcctccatccatttattaagcaaacgattgagcccttagtcaggatattggtttcatcctcttaaagaccaggcatacccaactggagcacagattgaaaatttgaatatatgccatacacacagacccttctaaggaaatcacaccaagtagattaatgtgagtgacatatctgtgacatccagagttccactctgttgcccaccccaaactgcttcagatcagggatcagagcatgtgctcataggctctaagttaacatggcataaaactgcccaattgttttatgtttataacattagtaattttaatagcaattgtagtagtaatatagtaaaaatttgatgtcaaacttatccaatcagattcccactcttagtatgacagttagattgcttttttttagaataaaattcagagactgttgactatttacaaaaatggaaactttgtctatagtaaggcctcctacattgttctagatgggtaggactttaaaaaaaaaaaaagagttctgcacacaaagtaataggaattttgcagttgtgatctgataaaacatgtctgtaagtaggacctgaatgtaaatacagtgagtgaggacttcccgtgggtagagaggctggcagtttttgagacgtctagtaacctagtttacattttaggttggttcctgttctctgctataatccctgtagtcaaccttaaatttttagtaagagtctactacatatacatagctgccttccatcagtgatgctttgaatgaagaaaactcctgtcaataaataggacagagtggggagaggcaggggggacgtcccaagaggcctaagtgtgaactggttgatcaagaatccaaaatttatacaagaaactataggagatcatagtcacctatgccatgaatccccttaagtcttcaagagggcactggactgcccactgtagataggataggaggtccaagccactttatctggtgattgaattaaaaagtggcctatagaagaccaatgcatgtcaggccattgaggtcaacttcataggcaccctgtgaagtccgatcctgctaacagcaaagctgcatgttttcagacagtcatgaagaggaaatactgatgacttggtttagtagtaacacttaagctcccccagcaaccaaacaagcagtcagaaatacaatgctgcctctactctccttctcatcttcttgttcccaaatgtgtatgttgtcagatgggtgcaggttgttgttccactttttatttctggaagaaaatgaagaattgcttcttgaaatgcagccagaaagcttttctgtaattaccaagaaaccagtcaattttattgacaatccaactgataacatatggtccaatactgtttgtttggtgtttttttgtgtttttgtttgattttttggttattttcgtttttgtcttttgagtgttttttgtttatttgtttttgtgggtttttatctttttttgtttgttttgttttttctctctgaacccagcacagtttggagtgatatcttaatttattattatgaaagggacagcaactggtttttaatggctacagaatggtgacttgcaaccttggcccagctgctgtcactgccgtgccgcgagcagacttgtagcatcttttctcagggacacatcagtgctcctgcctgctgcctccctccctcccagtggacaggccaccacctgctgctggcacagcgccggcccttcagggaacaaatgttctcttgctgctgggctataggacaggacagacgctggatttcaagagaaccagggaaaggcaccctcgggccggcagcccctactcttccacccatctgccttccctgccaagcagagatctcactcatgggggctgtaggagagtaggtgttttgaccagactgtggtcaagattggtctgtctccttttctacaccagtcttgctcaaggctatagtgggcatttatttattcaggccataagtatttattgagcctctgttatgtgccaggcaatttgctaagtgctaggagtatagacctcatcctctgcccttgagaaagtcactgtttagtggggtggacaagacacaccaatcgataaattatgatacaacactcagagtgtaataacagagtgaaaaacaaaatgcacagagaaggagcatccaagtatcacccaggtatgaaacatgtgggctttggagactgttagttagcctctgtagaaatctcatctttgcctcttgccacctgtttgaccttggacaatttacttaaggtctgtaagtcccactgacccatcattaaagggttatgtgagataatgcgatgaagtactttaacacggcacataggaaagactcaatacacgtgggccactactaacaaacgcaatttgtattcaaatgcctcccccagagatgcagagcatcagccattgcacccaggcaagggttctagaagcctagaaaggatggagaaataaggtcagttagtgggcaacagagcttagagccaaagaaggcaccaaacatctgtgtccaggggcaaagctggagtacaagaccaagttaaaaaaaaaatcgacccggactgtcagacaggaagggccaattagagaagaagaaaataaatccagggtgatgacagaaatcggagatattgggcaaaattaattccaaaaagagaacacaagcagaggtgaaaacttggagaaacagagacttgagaagacaaaaaattcttctcagaggaggtggtgtttgatctcaatcacagaagatgactagaagcttgccaggaagggagtttaggaaaaggcaatttttgaagtgggaacagcatgagcaaaggcacagggatgttccggggaagagcaacagtgtcttagtggctggagtgtgtggagtaaagaggaaggaggggaggctggaacatggcaggagccaagacatagtggactctgtgtgccaggctaggggatctagtcttgacctgtaggccagtgtggcatatcagagtcacctgtcaagctcttacaaggcaccaatgctcaggctacactgcccaagagtctgagtttaactcgtctgagttaaagccagccacgggtagtttttaaatctccccaggtgattctaatgtgtagtcaagtttgcaagccactgctgtaggcaatcagacatcaatgaagattctacttatatgcccagaatgctgtgaagctaagaaaagataattcatttaatttcagcaaacattattaagacccactcattgccaggccctgtgctaagccttgtaaatatggagatgagaagacagggtccactgctctctgtttagctctttagagtttatgaatcacgttcaccttcactgcctaatcctccctgggaatggaaaaggaatgtggttgcagtccttcaggggaagcggtatacataatcaactcagtcattgtggggcctaccctgaggtctggcactgggctgtagcggagaaaatgaattgagcaattttttatagaaaaaaatcaatagcatcagaacaggcagccacatcagcagctggggctggcgggaggggaaaggcaaagggggaggaaaaagggggctatcggagaaaacaaggacacttcatgtaaagaagaaatagaggtgttgtggaaggaggaaggaaaaagggccaagtggagtgggttaggggactgaggtggtggtttctgagagaatttggagaaaaccattagatcccttgagtcttaatccccctccactactcagagccctgaatgtggagataggtatgcaagaagttatgagagggaaattgacacctagcaagttcctgtcactgtgctaggtgtgtcacatacattaatgtaatgtaatcctcactaataaataagtttacaaatgagaaaaacagacatcctaaaggccactaggctacccagcttatgtgagacagagttatttatcctttttttaggcttagagagaaacatattggggagtagctttgtcaaagaggcactccaaaaatagttatttttccaacctcagaccacgtgtaacactagtacaaggctcagggtgggatggaacctcagagagcatctgctgtggatatgagtgaaccctgaactgggacctagctccagacgaaccttcacccttgtcaaaacacaatcattcaggttacttgaggcagatgagagagacggaaaaattccaccatgtaaccacagagagcatttttttaggaatcctcaggcacaacctcctgtgaggggagccccatggagggactatggccttccccactggagttgggggggcctgcagggtggggaatgagctcacaaccacacactggggagagaaacaggccttgtgagaaagccttgctggggagcagcagggacaatcgctggtcactctgtgccattaaactgcaggactgggtctcctgtgattgctttagacatacacccaactcagacaaggtcaagcagagcggaaatttattggaaggttactgtgttatctcacacaggtaggagtgtttgctgtggtttgaatgttgttccccattcccttcaaattcatagttgaaattataacctccaaggggatactatcagggaggtgaagcttttgggagatgattagatcatgagggcccttacgaatggggtgagcacccttaataaaaggccttgccccttccaccatgtgaagacacagcgaaaagttgccatctatgaaccaagaagagagccctcatcagacgctaaatccgccagtaccttgatcttggacttctcagcctctagaactgtgagaaataaatttctgtggtctgtgagcctcccagtctaagatatttcgttagttgactgaacagattaagataatattgaacaaccaaatttcaggaaaggatggttgtagttgggcctcagagcaattgaaatctgggtcatgaatcataaagactagtcctatcacttttctacacttctctgatggtttccttggccatcactgcagactaccttctgctgcaaggtgggatacgtggccaccaacaactcctgagcttcatattgcagattcgacctccagaggacgaagtttatttcttctattacagcttgaaaaatcccagagaaggcatctatgaaggattctgtttggtttagcttggggtggtgcctaccttgcaccaatcattagcacctagaggagcaaggctatgtttaacaacatggcaactccaactatatctatatgaatggaggaaggagggaaggttcacaacatgtattaatcccatgcaaaaacaatgtgcaacactgagagatgaataagacatggtcctagtcctcaaggtgctcacaatagcaatgtggcaaatcttcatgcccctttcctaactggacaaacagtagagtatatttcccagcccacatgtggttaggaatggtcatgtgactgatgtgtgaccaatggcatgtgtgaatcatttccagacctgttccattttaatgtgcttctcttccatgtgcttctccctttccagctgaatggaatggagacaacacccaggtaacatagaagagccatgtgtttaagattgcagaaccacagatggaaggagcctgactctctgaatcactgcacagaagacagaagagactcacgaaccacaagcatgcgcaccaggctcttatactagcaagaaaaagaattttatagtgttaagcattaagatttcaaggcttacttactacagctgctaggtctgccttcattaatatagttagtaaacattgcattaactggaattaactactttgagttccagctctatgacaaacttgctgaatgacttggagaaaattactttacttctctgagtctccccattaactgtacctacattgcaggatttttcactaatgaatagagataatgcacgtgaatgaatgtgaatgctaaattataatacttcacagtttcagggtagaatattagaaacttgtctctgccttcccatttctcaagtatgtcaagatataattttagtgacttagaaagctttcaagtatctcattgaaagtctcctatttaataaatgaagcaatgtaggttataaaaatgtagtttttcccatagaactcaataaagttattttcactttaatttttttaaataaatggcacttaaacattttttatatcctgcattagcattagatgaaaaatagcttgctcaccactgatattatcaagcttcattaacatcttgaagaaatcaaggctgaattaggggaaattttacaactttgcccttagtaattggcagatagccttaaacctgcaatttctgactccaagttagcatgcctccccattctctgtagttcttctcagccagggtactcatagctgccacagccactacatagattcacataaagctatggttatgggctcattctcagttgatccttctctctaccttcaccagagggctttgagtggagattcatgtaccctgttatatcaataatttcacactgtgttcctctcaactccctaggggccatttgtgtttgagttgtttgtttgtttgtttgtttgattgatttggatttctgttttttggtttgtttttgtttgtttttgagatgggggtttcactgtgtcacccaggctggagtgcagtggtgtgatcttggctcactgcaacctccccctcccaagctcaagtcatcttcccacctcagcttcccaagtaggtgaaaccacaggcacagcacgtgccaccacgcccagataatttttttgtatttttggtagagacagggtttcaccatgttgcccaggctagtattgaactcctgagctcagatgatctacccgtcttggcctcccaaagtgctgggattacaggtgtgagccaacacacccagcctgtgtttgagttttgagtttcaccactagtttaactagagcagcactgactttatctactttacatattgaactcctggataagatttcctttgaacaaaaagtttcctaattaaaaagatttttttgaaagccaatgaaccagaaaactgaacttcgaggtcacaatgtgatggcaaaggagacaagaaattcattttctaattccaagtctgatactaactcatatgactttaagcaagtatttctctttaaagcttcagtttcctttctataaaatggaaagttaaacaacaggagagcttacatccacagggcaaggcagcttagggtatgtatttggcattggaggtggaggcaggggaggtgggaggtgactaactatgagaggaagagtaaaaccccagataaagaggttttaactttattgaaagtactcattgagctacagctacgtgccaagtattctacaaagcatttgagaataaaacatggaaccaaacagagagcatgtatacagtaccagatctgacagtgaggggtgtcaatcacaagaaccagaggctgtcagtcagaaaggggatagcaccaggagaagaacaaaaggttctttgtttgaagttttttttcttttcccaaaaaacattcaatcatggtctcctttacagaatcctaactccctctcccaccctttcagccaagtcttctgaatcagttcccttaattattcattacgtattcatttgtcatttatatagcatatatttagtgaattcctcctatatacagcatcctgtaccaggcgctgaggattggagatgggttaaatttgataccagccctcaggatgctcatgatctattgtgaagacttgtaaaacacttgcaatgcaaggagggacacaggagtgagggtggaggaatcaccagtggtccttctccattccttaggggacgtcagattcctttacccctcccctacctctctgcacctcacctacgccttttggatgcactcccttttgctgaatcaacaagattaggcacagacatctgcactgaggaaataataagggcaccagaaggtcactgcaaatagaaggcagttatgttgtttcatgatttaaagtactgaatggtacatttatttccattaactgcaatgagatggtgttcacgtgggtgataacagtaggattttcacgacatcattttagcctatctggttatacaaacttctaggtttcctgagtatcgaatcttcctgaagcattgaagaataaaggatattctgtactttatcttcctttactgtccttcacctgatctttttttagttatagacaaagtcatccttattttttaatctttcaggtaagaaatatttactgagccctagtgcattccagccactgtgtattttacagacatataaatgaaaaaagaaatggtccctgatctcaaagacctaacagtctcatgagaaaaacaacaaagatgattaagttcaatgtgattagtgctatattagaagcaaaagtagtgataatgagaattccaagagaggaccataccaccagatgggaggttctataaaagcttgctaggaaagaaagcttatctgagtcaggagtaaagattcatggctagtcaagtaaatggaggttggaaaggtgtccaggcagatgggagtttgggcagtttttcctcctgaagctactgccccagtgaactatccaaattagatgtgctaataatgttcaggaattcaacatgccacatggacttgtgagtcagagagattttactctccttttttggtctgtgtcttcacctactcaggcatgattgtaaagttgaaatgagaaaataaagtggatgatgtgctccctacagtctccggcatcagtctgttctcgtaaatgatgttgggggtaaggggaggatgcataagggtaggtgaagtgtgtggatcggagaggagtgccttgggcatatctttgtaggacttaacttatctaatataatgaagtgtctatctcccatttgttctccgagatccattcccaacccctcatcaccagctctgtgcccttggagcctgacctgtttggactttaccaaagggctccctctctgatttccagttgagtcaagcaatggagggcactgcaggagaccagagagaaggaaagtgaggtcaatcttgctcctttgcattcatctcaggctgctgcatccttggcataagggcgcatctcctgccagatggtcttctccataacatgttctgtctctagattctgttaactgttccctcccattgtgtctcacacacaaggttaaaaatagggagctgttgttggcccaagggcattgcactatccttgaggtttccatacaacatccctatacctttataatgaatccttcaatttttctttaatcacccagtttgagtctgcattccttctggaattttaacagacacatattctgtaagccctgcaaagagattccaaataaatctgtggacactggaattaataaaggggtgaatgtatttcctctaggctagcatttacattgttaggagcatacccagaagctaaaccagctgaggaggaggctctccttcctatgtcctcttcccattaagctgagcaaattgagaacagtgcccaaattttattaatctttcaatctgtaccctcaacatctagctcaaaaactgggatacagaatctatgttcaatatgtgtgtgttgactgggtttccactcattgagctacagctatgtgccaagcattgtgcaaagcatttgcaaatataacatggaaccagataggatgtgtatagtacagtgaggggtgtcaatcacaaaaaaaacaagaggctgtccgtcagaaaggggatagcaccaggagaagaacaaaagtttctttgtttgaagtttttcttttttcctcaaaactcaatcatggtcttctttacagaatcctaactccctctcccaccctttcagccaagtcttctgaattggtggtagaggaagaatcaagtcattcccttacttattcattcactcattcatttgtcatttatatagcatatacttactgaactcctcctacatccagcatcttgtacgaggcactgaggataggagatgagttaaatttgataccagccctcaggatgctcatggtctatcgggaagacttgtaaagcacttgcaatgcaaggagggacacaggagtgaggatggaggaatcaccagtggtctttctccattcctcagcagacatcagattgaatgggtttccaatccagtatactggaaaagatgagggaaatataaatgtaatggcacatctgtatttgctgccctctccacactcacacacatgcatacacactaacgccataattatgacgttttataaaacattccaaaattcatttacttggtcattccaatcttgtttaaaataacatacctctggcagtctacaggaagaaattcttcttcaccttgtgggatcaggacccaaaactaccccatactggagatgcgatggaaaccctgttattaaatcaagggcctcagtgccagatggaagcttggaggccttgcgcatggctcagccctgcaagctgctggctgctcttctggacactgtcaagggcaggagatcctcttccttgggctgcagagccctctatggttgttcagcccttactgatgggatgggctccctcgagctaactcaaaatctgcctccctgtaacttctgtctctaagaagcaaacattctcttgactgatactgcagggccccaagataactgctttgaacaaacttcctgactttaaatattggtagagtaagccatggcctaagaggtgtgatttggagaggaccaggaggattgtgtgtctgagaggaccttctctgtccctcaatcccatctcccaccacctatgaagacttcagttttaatcacagctaggggtgcagacttgcacttagggaggccccttagaaacagacatagctcattgtaaatttctctaagggaagaactgtgtcttccatgtgttttgttttatgaccagacattgagagtaaattgctgagagactagaggagtgtcagatgaggcagaatctcacaggaggaggaggtcctcccatggacaccatgaaaaaagaaggtatctggaaataaggaacagcatttgcagaagcccagaggaggggaaagactccagcttattcagacaccacagttttaggtgagagtgtggagggcctgcaggaagaggtaagccatgggctggagtggaagcagagccaactctgccactgccccggagctatgaccttgggcaagtcactttaccactctctgaaatgagaaagattgggggagctatctcgtttctaaaggccttcctgttccataaatcaaccattctaaaaatgcctcacatttctgtagctcttcacagatcataaagtacattacctcatttcattctgcagcactgaaggcaaaacttggcggaattcagagttgaccttactcttttctgatgacttttcaacacaaatgcaaaactcagggcatccccatgtttttgcctctgaaccaacccctcaagtaacctagcaccccctttgctcagtacacacagacacacacacacaacacacacacacagacacacacacacatacacacacacacaacacacacagacacacacacatacatacacacacacagagtttcttaaggacaaaataatttgtttttaaaagagttcttatatttaaatttcaaaaagtgtcctgctgcccctcccctaccccaaccctaattaaaatgttaaaacagtcaaggtcacttctagtgcctggagggtaggcaagtcaaactcctaaccgtggaagccctgagtggtttgggaattcagtaacattccttattacagagtctaaatcctgggtattaagaaagggatttctaatagggatagatgaggagaatgggatcagggagcacttagcttcctcaatctagggtttaaaattgtataattaatccgaatgggacttaataagtgagactatatcgtcatgggagatgctggaaagttactattagtgtagatctgaccaacagagagatctagaacaagttaactaacttctctgggtctgttttcttatctataaaattagggactcgattaaacaaccaatgaaatagctttccatttattatttcttcatttattcaatgcacattaactaataaactaccttgtgtcagacattgtgaaaggcactgatacagaaccaaaaaaatgttaattaaaattaactgtgtgtgtgtggggggggtgcatatgcacatgtatgtgtgcatgagcacacatgagagagagaccactccatgtcctcagagctcacattttggttggcaagatagatagtgcgaagaaataaaggcagtaaaaaatccttttgtgcaatgataatcaccgatacaaagaaagcacaaaggaaagaatgcttcctggtgaaagaatcagggaatctttagagactgagtgatgcttaagctggatctaaaggtgaataagacagagggaggcattccatcaacaggaaggagagcaaatgaagataggcttagggaaaaagaatgaatttgtaatgcttagaagccagagtgatgagaaagggtagaggtagcaagagatgcaagcaggagcccgaccatgaagagccaagtcagcccggctaacatgatgaagaatcactcaatgttgtaaacaagggagccacatgatcagctctacattcagtaaatgtcactctggttgccatagggagtatagactggagcagggaaaaacaggggacaggacctcactgaggaaatgaaaatcaccccattatactaggggagatagagtctgaactaaggcagcatccttagttgcctggagatgaagaggaagaggaatgtgtaaatttagtagcttttcagggactgctatgtgtgattcatttattcagcaatcatttacatggttttttactatgtgccaggcactgttctaagcacttagaaatattaactcatttaatcactacactacacctatgaagctggaacttctataatccccatacggtggatgagataaatgacacacagagaggttaagtgccatagccagtgaacacgtagtctccacctcgggtctatgctattaaccactaacactatgcagccaagagtgagtcccaaatttcttgcagagttgcctgttgtatggatggacatgtcatttacttcttgaaaggaaagagtcaagtttctctgggagctgtaaatcaaggcacctgtgacatcatggtggaaaagcccagcaggaattggtcaattgagtatggagcagaggaaatagttttgggctggagatctagatttggaagtcatcagtgtacagatagcaactgtcaccaagggggtgcctagactgcccaccgctgtcactggtgtagtccatgtgaaatggcaggatggtattcttcatgtttcacccctggtcctgactgcatgtcaggagctgctcctagggtatgtgtgtcattgtgttagttgtgaactagctcttgtcaaagaatatggctattttcattcagtcaccatgtttgaaggattatagaaatactttgaaatatacaaaaataataagcaattgagctgctgacaggaaataagactttgatagagaaactatagaaaggaactaaggcagatacaacctctatcaagctttgatttcatgaagtcctgcttagtaatcctactttttaatattttagaacctaaaggtaataattggtacaaaacattggaactgtaatttggtcacgctggttctgtatttacatttctttcattaaaaatttagtcaaaatgaataactgaagaaagagaggagcttaaaaacttttgcaactatgagttaaagattggaaactggtctactgaataatgactacactcatttaaaaactatggtgttttgttttatttttggagctcaaaaacatctgacaggatttcatggaaagcaaagataaggctcactggctgcaggcaagccacctcattcacatgcagctcagttactctttggtcaaaaccaataaacttgttaagtttttattatgtgctaggcattgggctgtatgtgttctatccattgactcattaaaatctcacaactgccaggcaagggcaaaattattgccttcattttaagaatgagaaagccacatttcagggaggggaattcacctgcctaaactcattcagtgaataaatgacaaaactgagaaccccaccaactgtaccaagtccacactcagtttgggcagtaatcaaagtatctggaactccagagcccagccatttcctcaatgccaatattatttcccttgctctctggaaggcctgccaagtattcttccactgctcaattttatccatccttcttgacaacatctcaggtctcacctccccaccgactccagcccagactgacatcattttttgccctttcctggcttggctgcaccacacacactggtatttggggctatggacttcctatggttaagtgctgctttcttcgcaacattgtaagcctttttcaatctactcttaaaaccccctgaaatgtaggtctcactcaagttatttaataaattttgccaaattaactgaaaagagattgctgagagtctctgatggagcccgccatacacagcacccatcttgttgtcttgagtcctgaacaaattgggaaataagaaaaagagaagcagatgaaggtcaaaaaatcaactttaatgactgtactgatagattggaggaggacaccagcatgagaaccaaaatgcaaacaccaaaatcaagaacccagcaatttaggctcagttatagccagggtgggggtgaggggcctggtcagatagcacacacagcatgacttagcagagtggaaattagctgcaggaaagtggtcctgctccttcccaagaggaaaaaaaaaaaaacagatcatccccagttattcttgcctcatgttttcatcaagtcttgccacctctcctgggacacagcaattccatatgaaaggagactaagaatgttcatagggtaaggtaaaggggaaaagtgggcccttctagaacaaagcgctgggtagttcaccaatttttcattctattctatgtttattgagtgtatatgaatgaagaataacagtatcctctacaaaacttctgagagtacctgaaaaatattaaaggctcaatcattataatcataattgtaattgtaacaaaaatatattgagcacttactatacactaggaattagactgttttgattccttataactaccatatttgacactattagtactcccattatacagatgagaataaccaaaattaaataacatttccaagctctcacatgaactaaacagcacagtcaaaattcacattcaatttttctacctctataagctcttagtgatgacagcacataagtagccattcccatttctgcctacaagataaataattccaagtcatatagcatttacttataatgctcatgtatatagcacattgactcttgtaaaatatggttcccagaagctgataaccttttattcttaacttctactaaagtgatgatcaatgtcaacagcaaatatacatgcatgtggaatagtggctatcattacatcatggtaagtggtatatacttggagtccaaaaacccaggcttaaaaggcagttcagacatttactggccatgacaggctattttgaagaaattacttaacatctcatatctattttttaatgggataataaaatttagcccatgatactgtcatgaggactaaattgaatggtctatttaaagtgcatagcacaaattctggcacatagtaaatatgttagaaagtattgctaagaggaaggcaaagggcaagagagaatgaaggagaagaggaagggccatccaatctctaccttggcagtgttttcactggctaagaattgagtgaagaaaagggggaggaaggaggaaggaagtagaagctacagcaggaaggcatatatgtaagctatttatgcgagcactgacggcattgcaatagcaggaaccactgtatctcctgtgattagaggaatatgtattcagagcagaactccagaattgcatgtgagacatgcgatgagacaaatattgccgcaaagtcatcctagacctgtgctatttatcaaagactttacttgactctccatctgacctaaattatggcaccttttttccacaatgaagaagttgatgtcacagaagaactcaattccctcctccatcaccactgcctgatgtcaacaacccccttcatgtggatctgccagtgactgctgtaagcagaatactcaaagtcttctgtcttcagtttcctcaactgtaaaatacagggcttcccatagcagctcctcaaggagtgtggcaggaatatgacaactgtcccatgtaagccatgttcagcagattcaaggacctcccttatacatgcagtccctcattctgcacacttcacactcattcttcttctttcctgtaatgtaggagtaagcttctgtgtaaagtgacaagctcatactgttttactgtggttaatttgttccaattctttctactttattataattttttctgttgtagttgagtttaggttaataatgcacaatattttttctcaatttttaaacactataggtgtttaaatatattttttctaatttgatgtatgaattgtattaatatctgactttgcagtgttttatggctctactattttgggtttttttaatttaaatttttatctttaatttttgtgggtacctagtcagtgtatatctttatggaatacatgagatgttttgatacaggcatgcaatgtgtaataatcgtatcacggagaatggggtatcgatctcctcaagtattcatcctttgtgttacaaacaatccaattatacttttagttattttcaaatgtacaattaagtgattgactatagtctccctgttgtggtatcaaatagtaggtcttatccagtctttttaactatttatttttgtacccattaaacatcaccatctccccccacctcacttcccaataccctttcccagcctctggtaaccatccttctactctgtatgtccatgagtttcattgttttgatttttaggccccacaaataagtgagaacatgtaatgttagtctttctgtgctgggcttatttcacttaacataattatctccaattccatccacgtgcttgcagaatctcattcttttttgtggctgaagagtactctgttttgtatacgtaccacattttctttagccattcatccatggatgggcatttggttgtttccatatcttagccattgtgaacagtgctgcaacaaatatgggagtgcagttatctctttgatatgatttggctgtgttcccacccaaatctcatcttgaattgcagttcccataattcccaggtatcatgggatggatctggagggaggtaattgaaacatggggatgggtctttcccatgctgttctcatgatagtgagagcaagatctgatagttttataaaggagagttctactacacaagctctcctgcctgctgccatgtaagatgtgacttggctcctcatctgccttcagccataattgtgaggcctcccagacatgtggaactgtaagtcaattaaacctctttcctttataaattacacagttttgggtatgtctttattagcaaccttaggacagactaatacagtaaattggtactggatagtggggcattgctgtaaagatacctgaaaatgtggaagctactttggagctgggtaacaggcagagattggaacagtttggagggctcaaaagacaggaagatgtgggaaagtttggaacttcccagagactcgctgaatagctttgaccaaaatgctgatagtgatatgaacaatgaagtccaggctgaggtggtctcagatggagatgaggaacttgttgagaactggagtaaaggtcactcttgctatgcaaagagattggcatcattgtgcctctgccctaaaggtctatggaactttgaacttgagagatatgatttagggtacctggctgaagaaatttctaacctgcaaaatgttcaagaggaagcagagcataaaagtttggaaatttgcagcctgatgatgcaatagaaataaaaaccccatttttctgaggagacattcaagcttgctgcataaatttgcataagtaatgaggagccagacaatggggaaaatgtctccagggcatgtcagagaccttcatggaagcccctgccatcacaggtcaggagaactagaagggaaaaatggtttcctgggccgggtccaggcccccctgctgtgtgcagcctagggacctggtgccctgcatcccagccactctagccatggctaaaaggggccaagctcaggctgtggtttcagagagtgcaagccccaagccttggcagcttccacatggtgttgtgcctgcaggtgcgcagaagtcaagaattaaggtttggaaacctccacctagatttcagaggatgtatggaaatgcctggatattcaggaagaggtgtgctgcagaggaggagccctcatggagaacctctgctagggcactgtggaaggggaatgtggggtagcccctgcacagagtccccattggggcactgcctggtggagctgtgagaagagggccactgtcctccagatcccagaatggtagatccaccgacaggttgcactgtgcccctggaaaagccacagacactcaacaccagcccatgaaggaagctgggaggggggctgtaccctgcaaagccacaaaggcagagctgctcaagaccatgggaacccacctcttacatcagtgtgacctggatgtgagacatggagtcaaagaagataattttggaactttaagatttgactgccctgttggattttggacttgcatggagccttgagccccttccttttggccaatttatctcatttggaaggggtgcatttatcaaatgcccatgcccccattgtatctaggaagtaactaacttgttttttattttacaggctcataggtggaagggacttgccttgtctcagatgagactttggactgtggacttttgagttaatgctgaaatgagttaagactttggggaactattgggaaggcatgtttgggtttgaaatgtgaggacatgagatttggaaggggccagggacagaatgatatgctttgactgtgtccctacccaaatctcttcttgaattgtagctcccacaattcctatgtgtcatggatgggacctggtggagggtaattaaatcatggggcaggtctttcccatgctgttcttgtgatagtgaataagtttcacaagatctgatggttttatgaagggaagttctcctacacaagctctcttgcctgccaccatgtaaaacatgactttgctcctcatttgccttccgtcatgattatgaggcctccccagccatgtggaattgtgagtcaattaaacctctttcctttctaagttacccaatctcaggtatgtctttattagcagcatgagaacagactaatacactcttcaatatactgatttcctttttggcggggtatatacccagcagtgggattgctggatcatacagctctggctgtatcattttcattgccttttgttcatttggccctctcagcaataccatgataaagaagaacagccaaaatgatcattgcctttcagatgaacaaacactttatagagattggggatcttgccttaactgtctcattaattgcaaacctgggacaaaagctagctcccctatcactgaagcccaggtcttgtctcttaccccttattgccacaaatgagaaagaagctggtaaatatggcagtagcccccagaaaatgtccatataaggagccactctctggtatcaaaaaattatttaattaagaaaagcacagaatgaggacagcctggtggttcaaatcttcagtttccagtggacaacagaggggaattgccatgggtcccatattctagggacagcccatcctcctgctagagaaagacttccatagatgtctcaaagatgaaattctctactactctgctaaatagaatatgagctccccagtcctagagtttccagctgtattgccagggtctgcaagggaaaataagaaggaagccctgacaccccaatctcagcacctgttttatctccttaaagtcttctctattccaggctgagtagccttagttccttcaactgcatcaagtatgcccaccatgttggttactcttctgtctgtgcactgcaaatttcaaatatccttaaatatgagtgctcaaatgtgacttccacagtgtgggtgtgtttgcccctttatcagtgtaactccagttcacatttttttgtcttttcagactttttactctgttgatttacattaaactcacgtttaattaaaacccttaaccactaattctcaaactgtggtgtgcatgagaagtgcctggtgtttgttagaaatctggatttcttactggaaaaacaaatccagcagcacaccaaaaagcttatccatcacgatcaagttggcttcatccctgagatgcaaggttggttcaacattcacaaatcaataaatataattcatcatgtaaacagaactaaaaacaaaaaccacgtgattatctcaatatacacagaaaagaccttcaatataattgaacatccgttcatgttaaaaatcgcagtaaacaggtagtgaaggaacatacctcaaaataataagagctatgtatgacaaccacacgtccaatatcatactgaatggacaaaagctggaagcattccccttaaaaaccagcacaagacaaggatgccctctctcccactcctattcagcacagttgaataggaacagaatagcagttctgaccaggtcaatcaggcaagagaaagaaataaagcatattcaaataggaagagaggaagttaaataatctttgtttgcagatgacatgaccctgtatctagaaaaccccatcgtctcaggccaaaagcttcttaagctgataagcaacttcaggaaattctcaggatacaaaatcaatgtgcaaaaattgctagcatttctgtacactaacaacagagagccaaatcatgaatgaactcccatccacaattgttacaaagagaataaaatacgtaggaatacagctaacaagggaagtgaaggacctcttcaaggagaactacaaaccactgttccaagaaatcagagtggacacatacaaatggaaaaacattctatgctcatggataggaagaatcaatatcatgaaaatggccataccacccaaagtaatttataggttcaatgctattcccattaaactaccattgacattcttcacagaattagaagaacctattttaaaattcatatggaatcaaaaaagagctcacatagccaagataatcctaagcaaaaagaacaaagctggaagcatcacactacctgacttcaaactatactacaagactacagtaactaaaacagtatggtactgtcacaaaaacagacacatacaccaattgaacagaatagagaactcagaaataagaccacacacctgcaaccatctgatcttcaacaaacctgatgaaaacaagcaatggggaaatgattccctatttaataaatagtgctgggagaaatggttattcatatgcagaaaattgaaacaggacccctttcttacacgatatacaaaaattaactcaagatgaattacagacttaaatgtaaaacccaaaactataaaagccctagaagaaaatctaggcaataccattcaggacacaggcaagggcaaagatttcatgacaaaaacgctgaaagcaatagcaacaaaagcaaaaattaacaaatgggatctaattaaactaaagagcatctgtgcaccaaaagaaactaccaacagagtgaacagacaacctacagagtgggagaaaacgtttgtaatctacccacctcacaaaggtctaatacccagagtctacaaggaacttaaacaaatttacaagaaaaagaaacaaatcccactaaaaagtgggcaaaggacatgaacagacacttctcaaaagaaggccttcatgcagctaacaaacatgaaaaaaaaaaaaaaagctcaacatcactgaccattagagaaatgcaattcaaaaccacaatgaaataccatctcatgccagtcagaatggcaattactgaaaagtcaagaaacagtcaagatgctggcaaggttgcagagaactgggaacacttttacactgttggtgggagtgtaaattagttcaatcactgtggaaaacagtgtggcaattcttcaaaaacttagaggcagaaatacaatttgacccagcaatcccattactgggtatatacccaaaggaatatatatcattctattataaagatacatgcatgcatatgttcattgcagcactattcacaatagcaaagacatggaatcaacccaaatgcccatcagtgataaactggataaagaaaatgtagtatatatacaccatggaatactattcagccataaaaaggaatgagattatgtcctttgcagggacatggatggagctggaagctgttatcttcagcaaactaaggcaggaatagaaaaacaaacaccccacattctcacttataagtggcagctgaatcatgagaatatatagacacaagggggagcaacacatactggggcctgttggaggggtgcaaggggatggagagcatcagaaggaatagctaatggatgctgggcttaatacctaggtgacaggttgatctgtgcagcaaactaccatggcgcatgtttacctatgtaacaaacctgcacatcctgcacatgtatcatggaacttaaaataaaagttgaagaaaaaaaaaacctaagaattgaactaccatttgacccaacaatcccattactaggtatatatcaaaaaaaataaataaatgaattgttctaccaaaggacacatgcatgcatacgttcactgaagcactatttacaatagcacaaacatagaatcaacccaggtgaccatcaatggtgaactagacaaagaaaaaaaaatctggatcctaattcagtagatctatggtgagactcaaggatctgcatttcataacattctctcccccttgcaagtaattttactgttggtgatgtttgtagtgcactttgtgaacactgatttgaatctttctcccagatgctttagataaagtacatagcctagtggtgttctttgtgtactcggatttgagggttcaaattcataacattgtattgatccctcttaaatgcaccagtaaaaattagtagtatgtggtgaaaaaacaaaatggactttggagataggaagacttgtgttcaaaacctggccttaggcaaataagttagctccctgaatttttatttcatcacctgtaaaatagaccacattcctgcctgggttgtagttaccattaagaccatgtatattctgaggcaacacattgtctgtcttatagaagatgctcaatatatattaagtccccctggctcatacctccattatcccagcataaggacattttgggggaacttgatactatcacccaattaattaattcttctttccagcctcatgtcatttgaaaattttgttggcattttacctctgtcttctcagccagtggttctcaaccatatcagtatatgggattcctctgaggaacatcttaaaagcacaggtactgagggcttttgccagatccttgaaataaaagtcttcagagatcaagagtggagaagcataggcttaaaaagctccccagatgattctgatatgcactctgattaaagactcaccagtctaagtaattggtaataatgtggtttactatgtatcaaaaaccagaaaattcacagaccctttaagccatacatattcactcctagtaattggttctgggcaaataatcatggatgagtgcaaagatttgtttacaagactgtttatttagtacatatctctttataagtaaaaacaggaagagaaggaaaataagttggaggaggagttggaggacagtgaggagaaggtgaagaaaggaaagaaactgattgcccagcagcaaagtattggaaactacaaaatataaaaaacaaaatgtggtactccttactgcacaccatcgtgcagccctaaaataaactgctacattttttaatagttacagaagaggataaaaggcataatcacatttttgttgtttaaaaatataattatgagagacatacaacaaattattagcaattaactgggtgttggagttacaagttattttaattcatagtcacacctcattttactgtgcttcgctttagtatgccttgtagatacacgtttttgacaaactgaaggtctgtggcaaccctgaaacaagcaagtccgtgggcaccatttttccaacaacatgtgatcactttgggtctttgtgtcacattttggtaattcctgcaatattttaaacttcttcatgattattatatctgttatgctgatctgcaatcagggatatttgatcttactatcataattgttttggggcaccacaaaccatgatcaaagatgggaaactttatcaatcaatgttgtgtgtgttctgactgctctaccaactggccatcccccatctctctccctcttcctctggcctccctattccttgagacacaagaatgttgaaattaggtcaattaataaccacacaatggcctctaagtgttcaagtgaaagcaagagtcacccatctctcacatttaatcaaaagctagaagtgattaaacttagtgaggaaggcatgtcaaaagctaaatcaagcctaaagctaggcatcttgtaccaaacagttactccagttatgaatgaaaagaaaatagtcttcaaggaaattaaaagggctgctccagtgaatacataagtagtaagaaaatgaaacagcttattgctgagaaggagaaagtttgtttttgtttcgttttgttttgtgtttttctttgttttattttaagacagagtctcactctgttatccatgctggagtgcagtggtgcaatcaaagctcactgcagcctcaaactcctgggctcatgtgatcttcctgcctcagcctcctgagtagctaggattctaggtgggtaccaccacaccaagctaatcaactaattttttaatctttttgtagaaatggggtctcactatgttgccctggcttgtctcaacttcctgggctcaagtgaccctcctgccttggccttccaaagggctgggttttgcacaagctaacatgattggcctggagaaagtgttaatggtttggatagatcaaatcagccacaacattcccttaaagcaaaggctaattaatctagagcaaggctttttcttcaatttgtgaaatctgagagagatgaggaaactgctgaagagaagtttaaagttagcagttggttcataaggtttaaggatagaaggcatttctataacataaaaatgcaaggtgaatggcaactgctgatggggaagctgcagtatgttatccagaagatctagctaagatcattgatgaaggtgcctgcagattttcaatgtagacaaaacagcctaatactggaaaatgatgccatctaagactttactagctagagaagagaagtcaatgcctggcttcacagcttcaaagggcaggctatctctcttgttagggactaatgtagcaggtgactttaagtagccaatgctcatttaccatttcaaagatcctagggcctttaagaattatgttaaatctgttctgcctatgctctggaaataaaacagcaaagcctagatgagagcacatctgtttacagcatggtttactgaatattttaagcccgctgttgagatctactgctcagaaaaaaagattactttcaaaatattattgttcattgacaatgcacctagtcacccaagagctccgggagatatgtacaaggagacgaatgttgttttcatgcttgctgacacaatatccattctgcagcccatgggtcaaggagtaattttaactttcaagtcttactatttaagaaatacattttgtaaggctattactgtcacagatagtgatacctttgatggatctgggcaaagtaaatttaaaaccttctggaaaggatttaccattttagatgtcattaagaacattcatgattcatgagaggagttcaaaatatcaacactaataggtgtttagaagaagttgattccaactttcatggatgactttgaggggttcaagacatcagtgaaggaagtaactgcggatgtggtgtaaatagcaacagaactggaattagaagtggagcctaaagatggcactgaattgctgcaatctcatgataaaacttcaatggatgaggagttgtttctcatgaatgagcgaaggaagtggtttcttgggatggaatctactcctaatgaagatgctgtaaacattgttaaagtgacaatggaggatttagaacaagcttgtccaaccttcagcacatgatcctcatgcagccaaggatggttttgaatgtggcccaacacaaattcataaactttgttaaaacattatgaggttcttttcctaaattttttttagctcatcagctattgttagtgttagtgtactttatgtgtgatccaagacaattcctcttgttccaatgtggcccaaggaagccaaaagattggacacccctgaattttagaacattatatgaacttagttgataaagcagtgtcagggtttgagaggactgactccaattctgaaagctgttctactgtgggaaagatgctatcaaaaagcattgaaacatcttttgtgaaaggaagagtcaatcaatgcagcaaacttcattattgtcttattttaagaaattgccacagccacctcaaaccctgatcagtcagcagccatcaacatcaaggcaagaccctccaccagcatgactcactgaaggctcagatgactcattgaaggctcaggtgattgttagaatttgttaccagtaaaatatttttaaattaaggtatgtattttttagccataatgccattgcatgcttaatagactacagtgtagtgttaacataactttcgtgtccactgagcactaaaaaattcatgtgactcattttattgagataattgctttattgtggtggtctggaatcaagcccacaatatctctaaagtgtgccagtaatttctctatttttaaaattttctacagaaagcatgacttttatatcaaaatcttaaaaatattctatttttcatgataagatttcgatcaaaactgaatatactattagactctcttcaggttaatatttcttcatcagaattatttgaccattgtattcctctgttctcacgctgccaataaagacatacccaagactgggtaatttacaaaagaaagaggtttaattgactcaattcagcatggctggggaggcctcaggaaacttacaatcatggcggaaggggaaacaaacacaacctctctcacatggtggcacgagagagaagtgcacagcaaaggcaggaaatccccttataaaactatcaggtctcatgaggactcactcactatcaggagaacaccatgagggtaaccgcctgcatgattaaattacttcccacttgacccctcccactacacatggggattatggtgtgactctgctttaaccactcatgagggccatttgtgaggtctactagaaactataattcaagatgagatttgggtaggaacacaaccaaaccgtatcaaccatcatcttttaaccagttctgaggagtatatctgcttactgagggcagagtgggcacaactactgtgctcataggttggtacatagatgttatttcagacgatcttcaaaacagtcttatatgttatgaactcttagtactctcattttacagatgaagaaactgagatttggctagattaagtaactagcccatggtcaacaagtaaatgatgagagaaactgagtgaaggtttcttgagatccctctgtattatttcttacaactgcttgtgaaccaacaaccatctcaaaataaaaggtttaattttttttttttagaggaagcaattggcagagcaaggattcacacataaccctgtctgattccaatgcctgtacattctcagtcacaccagtgctaaattggcattgtgttgctgctatctggcctttttctgaaccttgcctactcagacactctgagtgactttgtgggaactttgctaactcctggcgagctgtcctccatggtgtgactctgcttaaacctctcgcaaaggccatttgccaggtccactaggagtggcggaggggcagcctgccggttttggtgccaaggaggagcagagtaaaggaggtaagagtcagtgggcattttgcctgactgaggactctgggattggaccctcaatagatatgcaaattgaattctgtgtaatttgtgcttttcaataacctcagcatgtgttggatgtgtacaaaaagagccgtaaaataaaattgcagacaaaggggggagtcagaacatagaaaggggaagaatcagtttattccacaagccaaacaatgggtcataataaattcgccagccattagctctttggttgcatggaacaaagagattgaaatgaaatgggagaaaaaaagaatcacagttaactgttaggtggctggcctgcttccatttggccaaccagacagatcacaggatgggccagggagctgcccaggggcatctgctacctccatggggcagctcccactggtttgcaacccagccatggctcttccatatgtttaggtgtcatcagggcagtttttcattaggaaaagcatgcaataaaaagatgcagttgtgttttaatcagccatcagttaatccatagttacatgtccccaaaagaatgataagatatggtataaaagaagaaataaagggatctaaagtgaaaaacagacagagatgtgcagaaagaaaataaaggagaagcagagagaaagaagagagagaaattgacagagataataataaccagaactactattgccagtgctgccactccaaccaacagtttcatcatcatttttgagtgtcagctgtggcctcaaacccaaagagtatgaacagagaatgcagccctggcagaacagatacctggcatccctccacacactcctaggagccctgtgaagatggctgtgaacccatcttctggcctgagcatgtctcaatcactaaacttcccacattcaatcttagttaccttttcatctgttcatcctcctaatgtactccaaggtcgttgacagcaggatgtagagttcacctgcatatcctaaatgccaagcattgagcctgacccattttaggcactccaacaatatttacaaaatgaatgaatgagttttgcatgaatggatggatggatcaatgaatggatgggtggatggctgaatgaataaatgaagaaatgaataaatgccaagcttgctaatcttcacactaggtcagtgagttagctgttattgatcccatttacaaatgaaaaaaataatgcctagagaaagtcaagtcttgactctttatcctgtaaaatagcatcactcaaagaagactcatatcctgagaaacagaggagaacaaggttgggagaagtttagggagcaaatggatgcagaagaagaagagaatgagagaaaaaaaggtgcagtaaaaattgggacagagctaaaaagggggttctccttggtgcctttatagcagaggacaaggctttggctttgtttgaaaagcgagtaataaagtctggggtgagcataagccagaaatgtatgacatcatattagcatagaatcaggagtttaagatagactcctaaatcctatttggctctgacagcaggtggactgttgttggggatttgcaaactggccaaaatcatccctggtagtcctaatgcgaagtgaaggtcaacagagatttgataaataaacagaagtgctcagagattctagtgtctgcattaaaaagaggaaagcagtgcagcagctttgcttgggtgatgctgaaacaatcgccctcttaaagacataagccccatggaccctggttgccataattttcagagtaatatgatttttgacaaattcattaagcaataggacatgacagactgtaaattgctccctgttaatttatgtccactatattgttaggcatccagccaaagcttggttctgtctgagagcaaagatataaattgccgttgtgtaaccacagactggaatgctttgtgaggatcagagaatgatcaaatcacagaaccctcaactcataggagaattcaatttcttactcagatagtaacttccattgagtgtccattgtggaacagccactgcccttgaggagaattaatcaggatttcaggaatgcacatgggttgttctacaaagtgataacccctgcactaaaggtaaaaagtcatttcttacagagcacaggaaaaaacagtcatcagttttagagaagtagtgatgaagggaggggatcagggaaggcttcagagagaagatggtttttgaattgggtcctaaaataatcgcagacattcctcacatgaagaagcatggaagttcactataggaataacccacagaggcatggaggcatggtgtgtttaaagagcttgagcaatttggtacaactgtagctcagggtaaaagaaagagaatcagcagcatgttttatggcaaaagagtaagtttgcatcaaactgggaaggcttcaaacccatgctaaatgtctaggagtttattcaatagttcccttctctgcatctccattcaggcaattattgtcacactgggagactgaaggctcccagcaaaaacaatggtctggatgaaccattatttatcaagggggatataaaccctgaggctggtgtgctattctgatcatttaggcaacaataatgaaaagaacaatggtcaatctatgttgatcaccattgtcagggtcactcctagagagacatttggctcaggctggagcactgcaacctctgcagggctacttttattggggaggttagaaggcctattgcctcataatccaacaaaggagaaaggtcttctcctttccctctaagcatgtaaggagagacaagaggaagacttgggttttggataacataaatgtccatgccatcagcccttgtccctaatcattaagcacagccctttccacaaacccctgaactgaatcagcagattcaactccatgaacttgattcctctttaggttttcaccaggcatatctaaggaaattaaaagaaaggggaagaaagtgtggcaactgcttcctaacctggcatagcaaaatcaagagacttgatttgcaaaaggaaccaggacacctggattttattctaccctctcactcaccagccccatggccttgaacaaagactaaaatgagatgatgcctgtgaaaatatctggcacggagtaggccttcaaaagatgctattgaatctcaatctatagtcagctagtattgatcttaagaaatcaacaaagtccatacaggaaatgcccaatacattggaaaaaggctgcagatccaagaataagctcaatgaaatcatcaacataatctccgaggattgtaagagtttctttgtactttgttcagttattttcagccactggagacctactatcaggtcccattttatgctgatattgttcacgaagttggcatgctttactggtcttcttcaatctacacacagggagacaaatcccaagaggttgggggaagttttgtttcatgtgaatctagctatgatatgaaacgcattgagtccttggggattcctgacatgatttagacgttctttgcctgcccactgcaggaggctttacagaaaaggcattctgtcatctcagtaactaatgggaagcagatgagtggtagaaagaattctggttttgatctcaggaggcctgaatttggaagctcagccctgtcacctgggagaccttggacatattagcttttctgagactcagtctgcttgtctaaaatgtaaataatggaatctactatttggggttatttcttgacccaaatgatataacttatgtgaaagcactttataaatctgaagtgccaacaattgtgagtgttataactctcatcatgattatttatggtgatgtagtgtataggctttgctgtcagttaaatctttcagtcctcatgtccctattaccccttggctactgtctctattactcaggagcacagcaggagacacaattcattcccagatggttcaaatggggagacttgaatgaagcctctacttagagaggtgcaagtgaaaaaccaaaagaccagcaacagctggaaggattactaccccctatggctaaagggacaaatgaaggaaaagcttctaccagagctctgtgaagacaagcaacctgaaggagaacaggctacccggagggatgcagctattaccagatgtgggacactgctacacaggagacatctctctcctgcccaccaatctcccattggttgaacccaatcagaaggcaactcacaagggattccaatgatataattcacaagatccaattctcaaagacacaaacttttagggtcctttgttagagtaaaactccagaaaaggagttgtacagcaaaataaaccttagatcacaaccaaattgggggacatcagggattctctggatgggggagctcccaggcctcagcaaattgtcctattggtttgagcaataaagattgctcaagctggttccaagcaccaagaggagatttgtcaaggtcagaggcacctcaattcagaatcccttcatcattgccaattgtaaacaaaaaaacatctaagccaagtctcaatcaatttagaaggcttattttgccaaggttaaggatgtgcctgtgacacaacctcaagaggtcctgatgacatgtgcccaaagggattagggtacagtttgattttatacattttagggcgacatgagatgtcaatcaacacatgtaagatgtgcattggtttggtccagaaagacgggacaacttgaagtgggggcatgcaggtcataggtagatttaaagattttctttattattattattatttcaatactttctggagaacaggtggtgtttggttacatggataagttctttaatggtgatttctagatttaaagattttctgattggaaattgattgaaagagtcattatcaaagaatgtctgggttacaataatggattgtggagaccaaggttttataatgcagatgaagctccaggtaacagacttcagagagaatagcctgtaaatgtttcttatctgacttaaagaatctgttctatcagtaattccaaaaggactgagggtataatgaggcatttcaggctcccccttcccatcgcagcctaaactacttttttaggttaactttggaatgcccttggtcgagaggaggggtccattcagatggttgggggtcttagcattttatttttggtttacactttctttttttttttgagacagtttcactctgtcgcccaggctggagtgcagtggtgcgatctcagctcaccgcaagctctgcctccccggtttatgccattctcctgcctcagcctcctgagtagctgtgactacaggtgcccaccaccacgcccagctaatttttgtattttagtagagacggggtttcaccatgttagccaggatggtctcaatctcctgacctcgtgatccatcctcctcggcctcccaaagtactaggattacaggcatgagccaccatgcctgatgggtttacactttctgtattgtgcttttcattgtgctcttcatatcagcatcaccagtggttacaagcaggagtctgagccatatagatctgtgttcaaatctgccacatatgattttaggtaaattgacttaatctctcagaacctgttttctcacctgaaaaggggagcctataagagcaccaatttcataggataatgtaaatatcaaagctgtaatacctttcaagcactttccaatgtgcataataagcactctgtaaataagaatgttgctgcttgacttctcacagacccactttttactgcttacccccaccccacaaacctccacaccggaaatccttttccatggagatctcaccttctcacatctttaacctgtttgataattccacctttttttctaactgaaaacttgatctctctggtagacttctatttcttttttacttaacttctcagtagcatttatactattgcttattccctccctttaaaaaggctttcttcccttggcttctgtgtggttatctcctaggtttcaggttgcttggatagaccatgttaaaactgaatttattttatttcctgcaaaacatgctcatttcctcttactttaattaatgacaccctcatcattcaattgcataaccttcgatgtcttacctctttctcattccttacattcaataggtcatagggctttgtatgcattaaatctctaaaacatatctagaatccatctacttttctctatccctaataccactgtgtttatggagccatctccatttcttgccagctttatagcaataacttcctaaatggtctcagtccctcttatcttgtattctttacccattcttcacatcgtaatcggaaaggtggttctaaagaaaacattttctcctaccactacccttatttaaaactccccagtgactctccattacccttattagaaagcccagtctcataattgctagcaagatcctctatgacctaacccctgctaatactagatactcatctaggcacacccctttatctcactcaaccccagtgataacaaatgacttgaaaatcccccaacactttaactttctctcttctctgagtggtgtatatgctagccaagatcctccacccacaaacttagctaattctcactttgccctttgcacctcattttaaatgccatttcctccagtaacttttcctgaccctgaaagccctcctaggtataccaacatagccttaaagtgttaattcaatgaaggcagaaatcatactgatctttgattatatctttaaacattggtgcctagcactgggtacttttgaatgagggaagattcagcagtgcaagatcatccctgtctgatctccaatttcccaaaagctcacagtagtaactctagaattgtctcctaactagagttaaaatttagggggatcaagcatggtcttgatcttgagccagttatgcttaagatacaactcaccatttttgatacatcaattcacaaagaacctctggaaccctgttcatgttcacatagcagtagagggtcaatcaatgtgaaatgaaatggcacatactttcaaagaggcctatgtaagtgcaaagttgattgtgatctgcttcttgcatttgttttttctgagtgttctacagcagtttctcatcttaggaaagtccttcaggctagttcactgatggatctacttaagtgcataagttttgccactagaccaaatcataaatgtcaatctttctctctggtaacacaactcttcagccacaaagcacagtactgaatgttttggcacacatactacaaaaaagtcattcattgtcctttgctttctttagttttcactgttaactcctagctaagcttccttatgtcatgagaagtaattctactaaataaaacctggttatacattaagaagacatctttttaacaaggaaaaatcttcagtttcagagttaagctttaacaagttttataaacaagagacttcaatgaacacatgctgggtaacagatttctataaatctgtaaactaacagagaaaagatagtttatctctaaggcaccacatagcagcacacagagagatgaagccctaatataatctaaagaaaatgtggctatacactaattattatcaatgataagtcatcaaaagaatccctactttctatttccaaatcccaggctgtttccaatacattgcactgtcttccttcagataatgaaaaagaaataattgtgattcctatactcactaagttaacaactgaacatgcttgcaattgtcagattatgtcagatactatgtataatgaattttgcaatactaggaatagatactgaaagaatcaagaagaaatggagttcagaaagcttcctgaaaaattttaagaaagtaaaatggagggaaaaagaagaggaaaccaaacattaaaaatgctttattaaggcactagagccatgagtatgtatacgtattcatgggaaaggtcagaaatatgtgtggtgaaaagcagtaggaaataaagttagacatgtagagatggtccgcattttgaaaaggaaaagataacattaaaaatccacgtccaactcaatgttctgctttaagagaaaactgtctttaattcaacttaactatcatcaaaatatgctgcgtggctgcacacaaacctttgatgattttcaaagcttggaattaactaaaatgactttatttagcatttattacccacttctacaggcacgcctagtagtaagcactttgaatacattttcacagaggatctacacaagaaccctatgtggtaggtacaaatgtgcttccctttccacaatgaagaaactcgggccagaaacattaagacatatttccaagtcagagtagttaagccaggattcaatgcaggtctttctctattctagaatccacaacttcagctttcatagaatttaccctctcgtaacactttaaggatgatacaggattgtgtttcttaaacttaacacttggcccttctcccctctagcatcctaaggaagctgttcacataaagaaaaattagagaaaagaaaccaaggaagtgattgtccaattcagagtttctttaatatgctgggatgacacatatgcctgaggctgatagatgtaagatgggcttcccacttcttctgactctatctaagatggtcaaattgcaaagcagaatcaacgtgacatgtccatcaagatactgagagaaaagaccacgagcccacctgtttagatcaggtgctgcgaggacatgatggaacagcaagaagagctgagtcctttgccttgaaggaactgtaatcctgcccaccagaattgtggacacatctgagcagaaaatctttctcccttatcaacatagaggaatcctggaagtgggggaaggcagtctgaggcacaacttcacctgaaggcaagatcagaaacacgggagaagaggcaaggaacccctgacttcacctcccccaccacacacacacaaacaataagtgtaaaaccgtacattcaaatagcttctgcagttccctaagcattgtaatatttattatttcacttgaacttcacaacagcccttgaggacaaaaccaagacacaaagaggttaagtgactttcccaaaatcagatatctagtaaattacccagccagcctccctaataacctcatctttctgaagtcactaggacaaatcttatctcaccactgagtgtagggagtgaaaaggtcaggcagagaggagtgtcatgattacagttcggttagaccacttagacacatccttccattccagcatttcccctaagtcctatttcaaaatcttagattatttttaaaaagaagaagaaaggatacatcatacaggtcacatctctgagtcctatctaaaatataacttaaaaaaatgaatttataagtatttcaatggttttagtcattgaaatcaactcttaagaataaataattattcatgtgaaaaaactatttattcatagtttccaagaatgtctctctcagaacaactttgtacagtttatgtaaatggtacccctgtaataacctgcataacctctatagtcacatttatctccctagtcataccatagtacctcaatccctgcacaatctttgagtcagtgaaccacagagtaatatattatccattaatttattttaaaacaaatattgaacacatactatgtgcaagcccaatgctaggttctgggaatgcaacaacaaacaagacacattttctgccatcaaaacttcatagtttgcctatgcttttggtgtcaagccaaaaaaaaaatcattgccaagaccaatgttaataagcttattctctgtattttcttttgggagtttcataatttcaggtcttacgtgtaagtctttaatccgttttgagttgatttttgtgtataatgtaagataagggcccaattttttttttttgcatgtggatattcagttttctgattaccatttatggaagagaccatccttttcccattatttattcttggtgcccttgtcaaagattaattaatggtatatgcataggcttatttctgttccattggcctatgtgtctgtttttagcaagtattctactgttttgattaacataccttgataatatagttggaaatcaggaaatgtgatgcctctagctttgtttttctttctcaagttggctttggctattcagagtgttttgtgattccacataaattttagcattgctttctctatttctgtactaaataagtaggactacgccaaactaaaaaggttctgcacggcaagtgaaacagtcaaaaaaattaaaaggcagggagtggggagagcaacatggcttaatagaatcctccagtgatcgcccctctcccacaggagcaccaaattgaataactatccacgcaagaaagcaccttcataagaaccaaagatcaaatgagcaatcacagtacctagttttaacatcatattagggaaagaggcactgaagagggtaagaaagacattcttgcattgcaatcaccaccttcgccagccccccagcagtgtttggagagagaatctgtatgcatgggggagggaaagtgaagtgactgtgggactttgcgtaggaattcaatgctgccctgtcacagcggaacacaacacagggcagtacttgaccagtgcccttggagggaacagccagactagccctagccagagggaaatcctccattgcagcagtaggaatctcagttccagctagctccactactttgttcaagaccccagggctcctccgactaaagtgccctggggtcctgaatgaatttgaacggcaaaacggccttggacaagtcctggtgctatgctgggcttggagccagtggacttggggtgcacgtgagacaccagctgtggtggccaagggagtgcttgtatcacccctcccccaactccaagcagtgcttctcggggagagactctttccacttggggaaagggaagggaagagtacagaggacttggtcatgaaagttgagtaccagctcagccacagtaaataaaatgtcaagcagattcatgaagcctctgcatccaggccctagctcctggatggcatttgtatactcatcctgggtcagaagggaacccactgtcctgaagggaaggacccagtcttggtcctgattcctgataccccatctgctgactaaagatctcttcatccttgaataatcattcatggtagccaggcagtagccaccacaagccttgggcaaggcccaataatgtgctggcttcagatgtgaaccagtccagtcccagctgtggtggccacaagagtgctttcaccactcctcccccatttccaagcagtcttctgcaaagagagactccttctgcttgggggaaagtgagggaaaaaaatgagacactctgcctggtaatccagggaattctcccagatcttacccaagccaaccacagcagtacttctgcaagtctgtgagagttgtggctttgctaggattgtggcacttctgtgtgtagacatgactgtagtgaccaaggagttataatagattataacactgaattccctttgaatacctgaaacgccttctcaagaaggatgggtacaaacaagcacagaatgtgaagattagaatgaatgcctaactcttcaatgtccagacattgaagaacatccacaagcaccaagaacatccaggaaaacatgatctcatcaaacaaactaaataaggaaccagtgaccaatcccaagtgacaaaaatatatgaactttcagacagagaatttaaaacagctgttttgaggtagctcaatgaacttcgagataatgtagaaaaagagttcagaaacctatcagagaaatttaacaaagagattaaaattgttttaaatcaaaaagaaattctggaactgaaaacaactgacaaactgaaaaactgcatcagagtctctcaacagcagaattgatcaagtggaagaaataattagtgagcttgaagacagtctctgtgaaaacacacagtcaaagaagaaaaaagaataaaaaaggatgaagcacacctttgtgcttgcatcgtaagcacaaagcacctacctacgagatctagaaaacagcttcaaaagggcagatctaagagttattggccttaaagaagaggtagagcaagagatcagggtagaaagtttattcaaggaagtaataacagagaactttccaaacctagagaaagataatcaacattcagctataagaaggtcagtcatagaacatcaagtagatttaagcgaaataagactgcctcaaggtacttaactgaactcccaaagatcaaagataaagaaaggattctaaaagcattctaaaagaggaaagaaacatgtaatatataaagaagctccaacacatctggcagcagacttctcagtggcaactttacaggctaggagagagttgcatgacatattcaaattgctgaatgaaaaacttttatcctagaatattatgtccacaaaaaatattcttcaaacatgaaggagaaagaaagactttcccagacaaacaaaagctaagggatttcatcaactctagaactgtctttcaggaaatgttaaaggaagttcttcagtctgaaagaaaaggacattaatgggcaataaaaaatcatctgaaggtggccgggcgcagtggctcacgcctgtaatcccagcactttgggaggccgaggcgggtggatcacaaggtcaggagattgagaccattctagctaacatggtgaaacctggtctctactaaaaatacaaaaaaaaaaaaattagccgggcgtggtggtggcacctgtagtcccagcagttccagctactcgggaggctgaggcaggagaacggcgtgaatccgggaggtggagcttgcagtgagcagagatcgcgccactgcactccagcctgggcgaggcagagtgagactccgtctcaaaaaaaataaatcatcttaagttaaaaaactcactggtaacaggaagtacacagacaaattcagaatatgctaacactgtaattgtggtatgctaaccactcatatcctgattaagaagactaaaagacaaccctatcaaaaacaataactacaacttttaagagatagatagtataaaaagatacaaatagaaacaacaaaaatttaaagtgaggggatggggtcaaagtgtagaagtttttaaatagtttcctctttccttgtttttatgatcagagttaagttttcctcagtttaaaataatttgttataacatattatttgcaagtctcatggtaatctcaaagcaaaaagcctacagcagataaacaaaaaataaaaagcaagaaattaaaacatactaacagagaaagacacttttacccaaagaaagatgaaaggaaagagaaaggaaggaagaaaggaaagaaggaagggaagggaaggaaagggaaggggaggggaggggaggggaggacaatcagaaaaaaaaacaaaatggtagtaacaaattcttgcctatcaataataaaattgaatgtaaatgggctaaactctttaatcaaaagacaaagagtggctaaatggattaaaaaaataagacccaactatatgctacctacaagaaattcattttacctataaaaacatacacagactgaaaataaagtaatgggaaaagatattccatgtgaatggaaaccaaaaaagagcagaagtaactacacttatatcaaataaaatggacttcaagacaaaaagtatgaaaagagacagaaaacattattacataataataaaagggtcaattcagaaagaggatataacaattgttagtatatgtgtacccaacactggagcacccagatatataaagcaaatattatgagagttaaggaaagagataggccccaatacaataatagttggggacctcaatatcctcctttcagcattggacaaatatcatccaaatagaaaatcaacaaagaaacatcagacttaatctgtgctatagacccaatggacgtaatagatattttcagaatatccaacatctgcagaacacatattcttctgctcagcacattgatcactttcaagcacagaccatatgttaggccacaaaacaagtcttaaattaaaaaaaataaaagaaataatatcaagtgtcttctgtgactacaatggaacaaaactggaaatcaataacaagaggaattttggaaactatacaaacacatggaaattaaacaacatgctcctgaatgaccagtgggccaatgaagaaattaagaaggaaacagaaaatgtattaaaacaaatgataatggaaacacaacataccaaaaccaacaggatataatgaaagcagcactaagagggaaatttatagctataagtgcctatgccaaaaaagaagaaaagcttcaaataaataacctaaggatacatcttagagaactagaaaagcaagagcaaaccaaacccaaaattcgtagaagaaaagacataataaaatcagagagagataaatgtgattaacctccccaaaaatacaaaagatcaatgaaatgaaaagttgttttttaaaaaagataaacaaaattgacaaacctttagccagactaagagaaaaagagaagatttaaataaataaaatcaggggtgaaaaaggagacaactgatatcacagaaattcagaggatcattagagactactatgaacaactatatgccaataaattggaaagcctagaagaaacacataaattcctagacacatatcacctaccaagatttaaccatgaagaaatccaaaacataaatgcccagtaacaggtaacaagatagacgctataataaaaaatctcccatcaaagctcaggacccaatgacttcactactgaaatctaccaaacatttaaagaactaatccaattctattcaaactatatcaaaaaattgaggaggagagaatactcccaaattcatttgaagaggcaagtattaccctgatagcaaaatcagacagacacaacaacaaccaaaaaactccaagccaatatctctgattaacttagatgcaaaaatccttaagaaagtactagcaaactcaattcaaaaacacattgaaatgattattcagcatgatgaagtgaaattatttcagggtgtaaggatggtttaacatatgcaaattaaccaatgtgataccttgatatttcataggaacagaatgaagagcaaaaatcatatgatcattttagttgatgatgaaaaagcattcaacaaaattcaacattcctctatgaggaataaaacaaaaactggatatagaaggaacatacctcaacatgaaaacaactgtatacaacagactcacagctagtatcctactgaatggggaaaaactgaaagcctttcctctaagacccgaaacaagacaaggatgcccattttgaccactgttattcaacatagtactggaagtcctagctagagctattagacaagaaaaatttaaaaagggcatacaaattggaatggaagaagtcaaattatccttgtttgcagacaatataatcttatatttatagaaacctaaagattatatcaaaaatctattagaactggtaaataaattcattaaagttgcaggatacaaaatcagcatacaaaaatcagtagcattactatatgccagcagcaaacaatttgaaaaagaaatcatgaaataatcccatttacaatagctaaatagctacaaataaaataaaatatctaggaactaacttgaccaaagaagtgaaagatattgataatgaaaactataaaacattgatgcaagaaatttaagaggacacaaaaacatgaaaagatattccatttacatggattagaagaatcaatattgttaaaatgttcatactattcaaagcaatctatgggttagatgcaattcctgtcaaaataccaatgacattcctcacagaaatagaaaaaaaaaatcctaagatttatgtggaaccacaaaagacctagaacagccaaagctaaccttagcaaaaagaacaaaactggaggaattacattacctgacttcaaattatattacaaagccatggcaaccaaaatagtatggtactggcataaaagcagacacatagatcaatggaacagaatagagaacccagaactaaatccacacatctacaatgaactcattttcaacaaaggtaccaagaaactataatacattgggaaaagtagtctcttcaataaatggtgctgagaaagctggatatccatacgcagaagaatgaaacttgacccctatctctcgcacatacaaaaataaaatcaaaatggattaaagacttaaatcgaaaactactgaaataaaatatcagggaaactctctaggacttggagtgggcaaaatcatcttgagtaataccccacaggcacaggcaaccaaaaaaaatggacaaatggggtcacatcaagttaaaaagcttctgcacagcaaaggaaacaaccaacaaaatgaagagaaaacccatggtatgtgagaaaatatttgcaaactactcatctgacaagggattaataaccagaatatacaaggagctcaaataactcaataggaaaaaaatcaaataatctgattttaaaataggcaaaaaatctgaatagacattttacaaaagaagagtttcaaatggttaacaggtatacgaaaaaggctcaacatcattaataaccagaaaaatgcaaatcaaaaccacaatgaaatatcatctcaccccagttaaaatggcttttacccaaaagtcaggcaataatgaatgctggagagcatatgagggcaacccttgtacacggttggtgggaatgcaaattagggcaaccactatgaagaacagtatggaggttcctcaaaaactaacgatagaactaccacatgatccagcaatcccactgctaggtatctatccaaaagaatggaaatcattgtgttgaaaaattatctgcactttcttctttattgctgcattactcacaatagccaagacttggaattaatgtaagtgtccagcaacagataaatggattaaaacaatgtggtacatatacacaatggaatattatttagcaataaaaagaatgaaatcctgtcatttgcaacaacatggatggaactggaagatattaagtgaaataagccaggcagagaaagacaaatttcgcatgtcctcacttatatatggaagctaaaaaataaaataattggattcatggtgatagagaatataatgatggttaccagaggcagagaacggtaccagggaagggtagaaaagtggggatagtcaatgggtacaaaaatatagttagatggtatgaataagttaatatttgataacacaaagggtaactacagtcaataataatttcttgtctatttcaaaataactagaagcatggaattgtaatgtttctaacacaaagaaatgaatgatacatgcttgaggtgatggataccccaattaccctgatgtgattattataaattgcatgcctatatcaaaacacatgtacaccataaatatatatacctattaagtacccatagtaactaaaaatagttttaaaaaaaatgaaggggcaacctacagaatgggagaaaacatttgcaaaccatatatctgataaaaggttaatacccaaaatatataaggaactcatacaaatcataacaaaaacacaaatcacccaatttcaaaatagggaaaggacttcaagagacatttttccaaagaagaaatacatataacgcatattgaccaatagatgatggccaatatatatcaatgcaaatggccaatagatataagaaaaggtactcaacatcgctaatcatcagggaaatgcaaatcaaagccatgttgagatattacctcacatctgttaggatgtctcttatcaataagagttgtcaagggtgtgaagaaaagggaacatttgtacactgtggataaaaatgtaaattagtacagccattatgaaaaacaatatggaggttcctcaataaattaaaaatcaaattaccgtatgatccagtatttccacttctggatatttatccaaatgaatcaaaatcagtaccttgaagaaagatctgcactcccatgttcattgcagcattatttacaatagtcaaagtatagaaacaaccttagtatcttatgcattaattcattcaatcctcacgtcagccatatgaagtactataagttctattattaaacccattttacagatgagaatacaggggcacagggcagataagcaacttaacagacccagagcacctttatggtggtccttggctctgaaataagaattgagattctagagcccacagaatgtaatcacttcctctccgggagcaaacaccaggcactatgcgaacaaaataggagggaataggatccatcccgagtgtcagagaattgcacacatttcctgtctgggttacatatttcagtctccgttcatgctaatacaaaagtaaatactcagatctgaccttcagtgcctccccaaaaaacatcaaagtttgaagctgtgcatcaaagcaatacagtccattttgtgtcagcctgcaatattattagccagtcaggtttagggaagctgacaaaaaagaagatgtcaggaatactatatgtaatataaatataatgaagtgcagttgtcaaactttcttaactaagaaagcatatactttcttagttaaaaagaagagcatttcattggggaaatttctcacaaagccaaggtttcagctgaaggaaagaggcaagagtaaacaccagaagcccaagcaaaggtgcacagaggcggaggatgaatgtttagtctgtgtctggttgtctgcaaagaacacgtgcaatctgaagagattctaggggaaattgccaacataaacaagctctcaatggaggtatacatgttataaatttagaaagcatcggccagcactctcttgagtgtggctgccctttggtttgcccaagcagggtactcaaaatccccagaaagaacacactctctagtaagcacaataggagcctggtgctaccccaggtgctttaagcctcgcagtaacattaggagggaaagacttttatctctttctacaattgagcaaatgagtctcagaaatatgcccagagtcaggcttgtaagcatgtagtcagaatttgaatccacacctgactgccactgaagtcctttccactctcacttgctaaccctctgagtatttttaggactctcatcagacatcacataacctttaggttggcattcacaagctccatgagggcagggactacaccagtcttgttaatcatttaataccagctaccattgacaggacttatattggatgctcaattatttttttgaacttttaatatactttattttctagaatcattttaggttcatccaacaaaattgagtggaaagtgcagagagttcttatgtatccccttccccaacaagtgcatagcctctcccactatcaatataccatatcagaaaggcacatttgttccaatcaatgaacttacactaacacatcatcatccaaagaccatagcttacattagggttcactcttggtgttgtacattctatgggtttggacaaatgtataatgacatgtcaccacctttatagtatcagagtattttcactgcccttaaaatcctctctgctctgcagattcatccctccctccccacaacccctagcaaccactgatccttttactgtcttcatagttttggcttttccagactgccatatatttggaatcatacagtaagtagttttttcagactgggctactttcatttagtagtatgcatttaaggttccttcatgtcttttcatggcttgatagctcatttccttttagtgctgaataatatcccattgtcaagatgtaccacagtttatttattcattcacccactgaaggacaactttgttccttccaagtcttggcaatatgaataaaactgccataaacatccacatgcaggtttttgtgtggacataagttttcatctcctttggataaataccaaggaatacaattgctggaacatatgatgagagtctgtttagttttttaagaaattgccaagctgtcttccaaagtggctctatcattttgcattgaataagagttcctgttgctccacatccttgatagcattcggtttgtcagtgttttggattttcatcattctaaatggggtgtaatcgacaaatatttattcaataaattaatttttaatcataaattaaaatgaaataaaaattgaaatcattaagaatgtacaattataaaatctattatttgcattgtcacttcttaaagactggaggtaaatggagaccttccatattcaagctctaacctatcactttcatgtcaccattcaccatgccactgggcaaactgttcagtctgctccaagcagtaaatctgctgagtggagacgggggggttggcggggagggagaagagaggaggcggatgataagaatgtactttgggatcttagtttaaaatccctcttgttgctacattttattcttctctagccactgtattctgctgcctacatttgagctccaaatatagtcacatctcttttattattataattaattgctatgaagtctgctaccattattacaaggaaaaacagtagttccatattaacacatttctacttaaaagccaatattaaaatatgttaaatctatagtaatttaaactggtacacatataaatagaacaatgccaaattatgaaataaacccaaaagcatgaggaatttactatgataagtggcatttcagttgggaaaaaaatggattcatggataaacagagttagtgttgatagattcaatttgggaaaaaaatagggatcactacttcataccttacaccaaaatgaattatagaattatcgaaactattaataatttaaaaggaaactataaaaaggctagaagaaaacaatgtgatttatttaaacaatctatgagtagggaagggctttcaaagaataacacaaaatcctaaaactttaaataagttgatgcgtgaccacataaaaataaaacatttaaaaaataaaacattttagccattcataaatggcctaaaaatagtccaaagacaaaatatttgaaagatatgtttgtaattcatatcacatcagagggataattttcctaatacataaattgtgcttagaaaccagtgagagaaaatatcactaaccaatttgaaaaaagttaagttatatgtacatagtctacagaaaaatacaaatgggtctttaaaataagaaatgatgttaggtctcactcataatgagaaaatatactgagatgccactttgcttttaaaaactggcaatggggccgggcgcggtagctcatcacgcctgtaatcccagtactttgggaggccgaggcgggcggatcacgaggtcaggagatcgagaccatcctggctaacacagtgaaaccccgtctctactaaaaatacaaaaatctagccaggcacggtggcgggcccctgtagtcccagctactcggagcttgcagtgagcagagatggcgcgccactgcactccagcctgagcgacagaaccagactccatctcaaaaaaaaaaaaaaatcaaaaacaaaaacaaaaaactggcaatgatccaaagtttgaaaacatactcagatggcaaaggtgtgggaaaaaggcattcttgtatattgttgatagtactttgctacaagtgctaaatgaaacacctatcaaaattatacaggtacatagcctatgacctaccaattccactttcttgtattccgtcaacagatatacttgcacgtgtgcttgtgcatgatttctcgcaagtcccatctacatcaggagggagtggttaaataaagcatggtgtattctttgtcataaaagaggaggacaaagttctgtatgtcctttatccttatgaggtacaatcatcaagatataattttctattaaaaagtacatagctttgattgaaacagaaacacaatagcacataatataggactcctcttacatggcattcaagaccaggagaaactaaaagatagtgataaaagtgagaatagcaattatctctggagagaataggaagaggcacaagggagacatgggggtgcaggaaatatatatcttaatccaggtggtgatcacatgggtatatacttgagtaaaacgtcatcacaccatacacaaattctgcactttacacggccttttatttataaaacaaatccacaagcaagacactgtactatacatataatattctatactttgtgcaaaaaagagaaaaaatatatgtctgtatatgtatttgcttatacgtgcatagaatacctctagaaggctacacaagaaactgatcacatcacaggagggattctgggtgactaggagcaggggtgagtgggagactccttaccagatatcttttgctacttttgcattttagaccgtgtgaatatattaccttattgcaaaacatgcaatgaataaaaaaacacaccacctagaattgtccgagacctctggggcttactcagtcctgactacaaatgccagccccagaggaaattagagggtctaaagtcagctctctgctaatgttgcctctcatgccactattgaaggctgggcctgtaagatctgacagatactggtccaccaccagcccaataaattacatatataaaatatgtcagatcgttataggcacaagaaaaaaataaaataaaatacagaggtaaagtattaagcaggggaatgagtgggagaataagggagtcccggctattctaggtgggcggtttatggaaggccttgctgatgaggtatcatctgacatctaaatgtagcaaggagacaagcattgtaaatatctggagatagagcagttgaggcagagaagacagcagatgtaaaagccctgaggtcagagtatgcctgccatggctgagaaacagctaggatgccagtgtgggtgaagtagagagaaccaagtagagaacaggagagataaggagtgagaggtaagcagaggctaagatcacaaagggccttggaagccacataaagacttagatatttactctgggcaagatgggaaaccagtggaatatttcagcagggagaatcaagagattttttttggacctagttaatggagatactaggtgggatatacaagtctgggcgttaggaaagagataccggctggagatataaacctagaagtcatcagatttctcttccctccaaatgaattactctttggggtcattgggtttttggggggccctttcttgccagcacatcttgctccaatccaatccactcagcgaggttccctaacttcacatcataggaagtagatgtttggatatctatttctctatctcagaaggcaaactcctctatcaccaccactccatgtatcaaagactaaggagcacagcctttgaaaaatcacacacatgcgcccaatgtacacaaatccagctacactcttcttctagaatcatagatgcatatttacttggtttttttatttccttaaccaggagggcccacttaactaaatctcctctgaactaaaaagggctcctttgtccactgaaacatagctttacagacaggttaatgtcacttaaagtttttatttatgccttactaaggctttcatgacatttctataagttttcaccaacttttgtaagtcttttgaacatttttccatcattgtctatttctccttaactaacatctaaattatccatttgctcctctttaaaatatatatgccatccaacctttatggaactgaaatcaaggcacaaggcttgtttatcaactgaatgactatgagaaagtcacttcatttctgtaagcctaagtctccttatttgatacttcattattgtctttaagatgtgagtgacttatatttttgtttatatgtttctatagatttttaccaaattgatgataatgcttctgtgtctccaccaaaatctcatgtcgaattgtaattcccagtgttggaggaggggcttggcgggaggtgactgaatcatgggggcagacttcccccttgctgttcttgtgatagagttcctccaagatctgtttgtttaagtgtgtattaacccccctactctctctctctctctctctgctgtcatccatgtgaagatgtgcttgcttcctcttcaccttccaccataattgtaagtttcctgaggtctccccagccatgcctcctgtacagcctgcagaaactatgagtcagttaaacctcttttcttcataaattacccagtctcaggtagatctttatagcagtgtgagaatgaactaatacagaaaattgggaccaacgaagtggagcattactataaagacacctgaaaatgtggaagtgacttcagaactgggcagaggttgaaacactctgaagggctcagaagaaaacaggaagaagggagaaagtttggaacttcctagagactgttgttgaatggttgtaaccaaaatgctgatagtaatatggacagtgaagtccaggctgaggatgtctcagagggagatgaagaacttagtggaaactgaaagggcactcttgttatgctttagcaaagagactggtggcattgtgcccctgctgtagagatctgtggaatttgaacttgagagagacaatttagggtgtctggcagaagaaatttctaagcagctaagtgttcaacttgtggcacgactgcttctaaaagcctatgttcatttgcattaacaaagaaatgacctgaaactgtaacttatatttaaaagggaagcagagcataaattttggaaaatttgcagcctgaccatgtagtagaaaagaaaaatcatttttctggagtggaattcaagcctgctgcataaatgtggataagtacagagaaaccaaatgttaataatcaagacaatggggaaaatgcctccaaggcatttcagataccttcacagcagcaactcccatcacaggcccaaaggcctgggaggggaaaaatggttttgtgggctgggcccaggtccccactgccctgcacaacctcagaacattgttccctgcatcccagctggtccagctccagccatggctaaaaaagccccagatacatctcaggccactgctccagagggtgcaagccagaagctgccaaggtttccacttggtgttaagcctatgggtgcacagagggcaagagttgaggcttgggagcctctgctagatttcagaggatgtatggaaacgtctggatgtccaggcagaagttgacctgagctgcaggagtggagccctcaaagagagcctcttctagggcagcatggaaaggaaatctggggttggaggccccacaaagggtcccaactggggcactgcctaggggagctgtgagaagagggccatcatcctccaggaccccaaatggtagctccaccaacagtttgcaccatgcacttggaaaagccacaggcactcaatgccagcctgtgaaaccagcttagggtgctgtaccctgccaagtcacagggatggagctgcccaaggccttaggagttcaccctttgcatcagtgtggcctagatgtgagacatggagtcaaaggagattgtttggagctttaagatttaatgactgccctgctaggttttaaacttgcatagggcctatagcccctttgttttggctgatttctcccttttgtaacaggaccatttacccaatgccaatacacccattgtatctttgaagtaactaacttgtttttggttttacaggctcataggcagaagggacttgccttgtctcagatgagactttggacttggtcttttcagttaatactggaatgagttaaaacttcgggggactcttgggaaggcatgattgtcttttgaaatgtgagaacatgagatttgggaggtgccaggggtggaatactatggtttggctctgtgtccccaaccaaatctcatgtcaaattgtaattcccagtgttggaggaggggcctggtgggaggcgattgaatcatgggggtagacttcccccttgttgttcttgtgatagagttctcccaatatctgtttgtttaaaagtgtgtcttttacttctctgtctttctcccctgttggccaagtggagacttccttccttccccttcaccttccacaatgattgtaagtttcctgaagcctccctaaccatgccttctgtacagcctgcagaactatgagttaattaaacctcttttctttataaattacccagtctcaggcagttttttagagcaatgtgagaacaaactgatacaatgatacttacctagtgataactgattaataagaggctttttacgttctttgcaaggaaagaaggaaacattggcaagtgaagggaagcatgaagggaacacagtagcatgcacatagtagaaataatatatgtattattgttgttattattactattaacctgaattgtccattcattttttaacagataccaatattttataagacattgtgcttgtttccatcaagtaacaatatttgtaaaagtatatattgagtaatagtaaaatattaaaaactttcctaaagctcatcaataaatattttattcaacttttaagttcaggggtacatgcgcaagtttgttttacaggtaaacttgtctcgtgggggtttgttatacagacaatttcatcacccaggtattaagtctagtacccattatttttcctgatcttctctctcctctcaccctccatcctccagtaggccccagtatgtgttgttcccctctatatgtccatgtgttctcatcatttagctcccacttataagtgagaacatgaagtatctggttttctgttcctgcattagtttgctaaggataatggcctccagctccatccatgttcctgcaaaggacatgatctcattctttttatggctgcatactatttcatgatgtatatgtaccacattttctttatccagtctatcatcaatggacacttaggctgattccacatctttgttgctgtgaatagtgctgcaataaacatatacatgcatgtgtctttataatagaatttatattcctttggatctgtactcagtaataagattgctggattaaatggtagttctgtctttaggtctttgaggaatcaccaccctgtcttccacaatggttaaactaatttacgctgccacaaagagtgtgtaagcattcctttttctctacaatcacttcagcatctgttattttttgacattttagtaatagctcttctgactggtgtgagatggtatctcactgcagttttgatttgcatttctctaatgatcagtgatgttgagctttttttcatgtgattgttagccatatgcttgtcttcttttgagaagtgtttgttatttttttgcccactttttaatttttttttcttgtaaatttgtttaagttccttatagatgctggatattagacctttgtccgatgcatagtttgcaaaaattttctcccattctataggttatctgtttactctgttgatattttcctttactgtgcagaagctctttagtttacttagataccatttgtcaatttttgcttttgttgcaattgcttttgctgtcttcatcatgaaatcttttcctgttcatatgtccaaaatgttattgcctaggttgtccttcagagttttttatagttttgagttttacatttaagtttttaatccatcttgagttgatttttgtatatggtataaggaaggggtccagtttcaatcttctgcatatggctagtcagttatcctatcaccatttattgaataggcaatcctttggtttttgtcaagtttgtttttgtcattgattgtttttgtcaagtttgtcaaagatcagatagttgtaggtgggcaccattatttctgagttctttattgtgtttaattggcatatgtgtctatttttgtaccagtaccatgccattttggttactgtagccctgtagtatagtttgaagtcaggtagtatgatgcctccagctttgttctttttgcttaggattgccttggctacttgagttctttttgttgttgttccatatgaattttaaaatagatttttctagttctgtgaagaatgtcaatggtagtttaataggaataccatttaatctatacattgctttgggcagtatggccattttaatgatattgattattcctattcatgagcatggaatgtttttccatttgtttgtgtcatctctgttttctttgagcaatgttttgtagttctccttgtggagatcattctccttcctggttacctgtatccctaggtattttattctttttatggcaattgtgaatggaattgtgttcctgatttggttcttgacttgactgttgttagtgtattggaatgttagtaatttttgcacattgattttctatcctgagactttcctgaagttgttcatcagctgaaggagcttttgggctgagactacaggattttttagatataagatcatgtcatctgcaaacagagatagtttgacttcctctcttcctacttgggtgtcctttatttctttctcttgcctgatttccgtggctaaattaactagctatgtgaccttgaaaatatgctcaacctctctgagactctgattgctaaatctgtgaaatatagacaacaataattctattcatgagattgttaaaagtaatatttaaatgttgggaggataagcacttagtgctgtactagatctgatacggtgacactacacaaaacacttagtaaacttagataataattatccacatttacaacaggaaggtcagctggacagggcagataaagaatccagagaaaaactgaataccagttaagggcaatccaagaattcaggtacagaagacaagggagttcccagttttcaaaagttaagcagaagaaggtagatataatggagattctcacttaaagcagcagtattttgtccagatcaagttaaaatcaagcatgtattgagttgttcatagcagagaggagatggaacatagtgatcaagagactgagttttgtagaaagtcttgggttttagtcctgattctggaatataccagttatgtaacctcagttccccaacgctcaattcctcatccataagcaaaaaaataaaagtcctaagatttgatcaccaaagttccaacttggacccccagtgaacatcaagctcattgtggcagcaagacaggtgtcatgagagtcaggctaccatggagagatatactcaggccccggacacagacctgtattgactcctagattagatatgtaccatgcaatttagaacaagtttcttaatctttctgagccagagcttcctcaactatatattggagataataataatttctaagtaagatagggtaagcaaaacaccattacaatgaccggcacatactatgtgttcaaaaagtcatgatcactgttgcttatgcttgctctttccaggcactatgctacatgttggagttaaaacagtgaacaagagtacatttcattccatctttcagatatttaaagacaggtgccatgtccatatccactctggtctcttcttcagttccttagctattcccccatgacaagatgtcccaacatgaccctctctttcctggccattgttagacaagctctgttttgtaaataaccctttggaatatggcacccagagtggagatgatatccagccacgatgtgatcaacctgaaatgtcgtaagataagaatttggctttgaccttaacactgtacttccactaacccaaccaacatttctattagttttttttttttaattcctgcaatagttaaaaaggaaactacaatagaattgttgctaaactcattggcacagtgtacagcctgaaaaagtattcagttattttaagcaagctgaaaaaataaagaagtaaatattctgtatgagaatccaaagtagaatcatggagcagaaagagtctattatacctccttaatgttgtaggcagtcaagatcactctaaattagtaccacagagaagatggatgtttccatctggggaagaaaagaatccattaaaatgactatgaatagaaatacttagccaagaagaaataaactgtgagtatattttaaaggcaaactccatagtaaagttgagaagatctgtaataacgatgtcaaatatcttcttttaaatctcataaatcctaccacaggaatagagtggagtgagagcagatttatgcctttctacaaaggcagagtcttctaccaatacttgcagataacccagtgggccaccaacaagtagttactgcaacctcagaacttagacaatcccctttacaaattagaatagagtcctagaagacagattatattctcggagctgttttcacaggactattttctggctctttgatttatttgcttaggtctgagtgtcagaggcctgaaaagtcatctctggattacagagatgagtttagcatgaaagtcacattttgttttataaaagcagctcaagcatcagagtttgaatggctcggcacctctttaatcaaaccagggctgctcagtgcagggctttgtaagtgagctaattagtaatgtgccagagacctacctggttaatcaaatgattaatcactcagtagacttcattcctcttgttttctggctgtctttggctcctgtatttggtgtttttgtatttttggggtaactagcattttaatagctggcagccaccattcaggataaaaaaaaaagtgacattgtctcattttaaccattttttgtacgcataaaaatgagacagagggggttcctttctagaacaggttatatggcttgaccaagaaacattaagccagttctgaggaaatatgatgtttgggtagaagaggatttgaagttctgtggaaggtttgagccttcctttacgtatgcaggcctggttagagaaaagatttttgaaaatcacatgaccataaatcagctgacttgatttttaggtttcttccttctatttatttaatattttactctttaaagtagttttaaagggaaaagaaggctagccatcttggcaaattctaacattgaaaatagggttgcatattttatagttttgttgagaaaattgataaagtaagtgctgtagtttggatgtttgtcccctccaacctcacattgaaatttaatccccagagtagtgatgttagaaggtagggcctaatggaggtatttgggtcctgagggcaaattcctcatggatggcttggtgccattctcacagtagtgagttagttcttgctctgttagttcccataagagctggttgttaaaaagagcctggcacctcccctttctcacctttgcttcctctctcaccatgagatcactgcacacccagcaccccttgccttctgccataagtggaagcagcctgagcttctcaccaggagctgagcagatgccgttgccatgtatcttgtacagcccaaagagccaacagccaaataaattttttttaattttataaactacccagcctcaagtgtacctttatggcaacacaaacaaagacagtaagttaactttaagttccattttatgtgctttctagataagacatattaaaaaagaacaaatgcattcctttaactgcaatgttccagctctgatcatttccagattaatgatactcttaaagtttagttatccaaactgttaaagagcttaattattgttttaaaatataataatataatggaccaatttcaatttaatatcttaaaatcattgtccctcaaaaatacgcaaatggctaagaactatattaatcagtttccagaaagatgtgcacaatgtcattacaagtacccatgaaaatctgccctcctgccctgtccatgtgactcctcagcccgtcttcatagccctgtggatcttcaccatgcacacacaccataagagaagatcctcttattatcccaatggcatggatggcaatataacaacaattataaatttgttcacaataattattttggttcattcctgtatttggactccaaagtaaattgttttccattgccacatatgcaaaattcctacattcccagtacagaaaatgtaatcaaataatacttgacttttttaaaaggctagtgtaagcctgaaagtagttgcaagtggcataagggtcaataggcttacatcctgaaaagctgtggattccctaaccttctggaaacagcaacatttccagttggaatttctctgtttctctctcttttttttttttttttttttttttttgagacagggtctggctctatcacccaggctaaagtgcagtggtgcaatctcagctcactgcaacctctgcctcccaggctcaaacaactctcccacctcagccttccaagtagctggggctacaggtgcatgccatcacacccagctaacttttgtattttttttgtaaagacagggtttccatgttgccaaggctggtcttgaactcctgggctcgagcaattcatccatctcggcctcccaaagtgctacaattgcaggcatgagccactgagccaccttgcccagccctagctgtaatttttcaagctgcatggttcatcatctcttcaaagtaagtccctgatcttctgctttagagagccactgtttctggtgagaggaggtcaagcacctcagggatggggtgagagatgtgtggtgtgtgagtgtgcatgggtgtgtgtgagtgtgtatgtttgagtcaagggagaggtgaaggtcaatcaacattactgggtgccttaaaaagcaaacagaaattttaaggatgggagtatccttataacttcaggataaaatgaaaaaacatgggagggttgagaatccaactggagggattatatttcatttattcatatttcaatactgtcccagaatggtttctagaaacctataatgtaggcaaaaattagttcttgaggcaaagctttgattataaaaaaaaaaaaaaaaaactcacaaaatgaaggattataaacaaatacctctaagttaaagtactctttaataactagaaaacagagtcatcaaaagagaattcaggataaagactaattgttcaccttatttccaaggcagcccatccaagtagaggtcctgaggggggaaatgtggccatttcctggaccaggcatatcctgtggtcaggagcagtcctggaaatattaaaaaatgtgacatgttatcagtttttccttcttcagttttacccatctccaatctgcctgcctccagaattatctttttaaaacacaactctctcctagtgatcagttcaagctgccttggacttgccacagtgttgtccatgagatttccctagtgtccatcattccttcccccactctctccacttctggattacattaacccaaaacaccacaaatcttgtagcattctgttcccactggactaaaacagcaccctccatcatcttcaagatctctccaccaaataatttctggacttccacaggcagaatcttactccttattcctgaacaagtctactcatgcaggcctctgcacctggacactaggtgtcaaggtgcccactgttcctctacagtactcaaccaagcccttgtaaaccaaaaataaaattctaagccccccaaccaattgaatggacctttctctcagccaatggcattccaaagtaaatctggaaaactagttcaagccatgatggcaaagggggagtcagacttgcctcattatatccttctccctttggaattcaggcataactgaccatcattaacattaaaatagaaatcttaagactgacaaaagactctttgtaacaatgaaatatcaaatttcaacatgactccagtataacattacatgacagatagcaggtcttcaaagaaatcgaagtattttaccccaaaatatacttaggtgacatattttgaaatggccctgcaagtctgtctcttgtcaaggaaatctacattctggagagattccccttacctttccaggtctcttcctgatccaagaaagattaacttagagtctggcatgtttttaactctgacaagaaacatttaccatctactttctctgaagcctactatccagaggcttcatctacataataagaaccttggtctccacaactccttatcttaacgcgtatattcctttttattgattccgggactttagataatagcttaaatatttaaaccaattgccaaccagaaaatctttggcctggaaggacacccccacttcaccctccacttcaagttgtcctgcctttcgagactgaaccaatgcctaccttacatgtattgactgacatctgcctgtaacttctgtccctctaaaatgcataaaatcaagctgtaaacttctaaactgattgagacttctctcagatattttttggtttatcccctagaccaagattccacagcagttttacctctgctctgccaagcctcatgttcaatgacccaaaagttttgatgtgcgtaagcaccaaaaattttggtaatattctgacaattggagaaaaacatttctatcccttttgtataaacctccaagaacagagaaagcagtaccaaactgtatgcctcttatcccaaagtttgcagatatttaaacaaagcagttattttcatttctatatatggcaactctgtgccgcttaagatccaccctttaaaaaagcctaaggcaggttaggaaacaaacccaaatggcagccagagcataggttttttcttgggagtcagctacccacttcttaaaacctaaggcctctcaactggctctccatacatgcccaaatgtgtctatctggatcccacaagtggaagcattatgacttctttcacaggaggatcctcaatatcctccaaaatagttccatcagatacaaacctgaagttttcccaatagcctcaagcatgcctggacctgtaagcagacatggcccatgctcaaactgaaacccagctacaccttgatttatgggttggatgggagaacatgagtatctgccaaaaaaaggaagtatttgaaccacattttgaagaaagagtcagatttatgcaaacactgtggggcaacgattcatgaagagggaacatgacagagaaaacagaatcatgacagaggccaaatatctaatgacttcattttaatcaaactttgttaaggtgtccagagaaggacatactgacattctttgagatcatattgacttacagtaaccactcaataaattttgttgaatgaataaatgaacaaatcatttcactttttttaagtgaattaaatttggctctgagtcccagcttgctacaaacaagaaggattccatttcagtcacttttgaaggggaattccttctcttcctagggttttaaagacaatcaaggaggttgacgtggtgtccaaaaagtgagagattactccatcatgtcatcatcttccaattgtctgttttgtgcatgaggctactgggcgaacttgtcctcccccatctagcaggtgaggatgcttcaggtgggctcagatgtactttcacagcagtccttttcactcaacagaggcctgactgcaaaaccaatgcctgctcgtaaagcctcagtgtcagcctccacaatcctctcacagacacctccccatctttgatgcatcagacacagaggtcacggatctccaccactcatggaaacactaaagatactacctagccctgtctccaccagagaaaaggaaaacatctcctttcacctttgagtgaaccccgttctatttcctgggcccacagcaccttataaaccatagcccgaatagaagtatgtgtgtttttttccaggtgctttgcaatttctgtttttaaccctgatgcatagaaactattaacaatcccttagaaagaaactcaaactcagaacacaaagattacctcttttattatggtaaggaagaggaaaacatctcttgtccattcaggtctcttcagagtagctagaacaaaacccaaaataaagttacagcatataattttgccccatcatcacactaatccccatgatactgtgcataactgcgtccaaaaaaattgaattaagagtcagaagactctaccatcctggatgcacttcagcacagtatggtcccactatctccatgtaaattttgtcctagagacctcccaagactatcatctccatgtaaattttgtcctagagacctcccaagactatcatggagatcaaatgagaaaagaaattttataaatgctggaagccagggaaagagtgcttgctagtgtagtgtggaccatgccaagagccaagacacatctaattagctgtgcctgctccctgtgattctgaaaaaatgtcctcagagttctagtaacctgtctgaccttggaaccagtgccccatctccttgtgggttgttgtcaccatttcccctacaatcctagaagaagaacaggccctagtggtgacccacaagaaatgccagggagaaatgcgatccttgggccactgcagggcaagagagcaggtcaatcacctgcgcaatgtttgctgtgggtcccgaggcctgaaaggttgctttgttcagccaccaggtaagctgcaagaggaaggtgcttctccagccactgccaccaagacctgcacaaagcacttattcagagatccaggcctagccatgccctctgatactgcctctgacttattggattgcctatacaaagatcatttccccacctgcaccctcccattcctgaccctgccactcagagggcatgggtagaatattacattccagagagaaaaggcaatattcaggctgaaaaagaccaggctgcagttgaggacaatcctctttcaccatagagctctcaatgtccctgcagacaataggcctctgtgcggccccatcttcttatgcaaggacaacttacatgttttcatctttggaaacttcaaactgctcagtccccaggaacaaggaaatgtctgtctaggagggatgaggagagaggaggtgagatttgtcacttcaaaataatctcctagccaggtttgtttattcccatgggcaatgccaaatttttgccagtttattctttaactcatttgaacagtcaatgtctacagaacatctaccatgagttaggtatcttgctaagatgcctagtaatagatacctaactgcaaagagaaaaattaaataagaccaccctaccctcaagcagatagtgtccaagggtctcaaaaagcattttgtgaattgattttgtatgggcatcctttttcccactaaattttacacctaatgtttgattttcattctgtcctggctcctgaatcccttctgagttatcattatgtgagcataaagatcaaaattttgagtttcccaggcactcttctactagtggaaatgcaaactgccataacacctattgaggataatttgacaacatatttaaaaactacatatgtgtttacccttaaccctagcaatattacttctgagatttaaccctgaatatacacctttaatatatgtgtattattacatatacatagtgttacccagtgcaacaccatttttatatgtaaaatattggaaagtacctaaatatatccaagaataaaagactggttgaataaaccatagtatatatacacaatagagtactatgctgctgttaaaaatgtgatgatctctacacactaatttgtagcaatttccaggagatactgttaagtgcaaaagcaaaatgcaaagtagcatatatagtatgctatcttttctgtaaaatatgagagaaaataagaaaacataaaagtctctgcttaatcttaccccctacaaaagaaagaaaagaaacaaggaaaggaaaaacagaaaacaattaagttggttacctacagagatgaggaaacagggagaaagagatatgggcaacagtgacactcctctaataatagagctgcttatagggctttggcttgaaaagctgtcaatgttttacatattaaagaaaataaaatgtatccaataaatatgggaagggcaaaaaaaattctgaaagcaaaccataaaattgaacccaagtgtgtttcaaatgaattgcataacctcactgaccagagaaacaggtagagaagtttaacaaaagtcatatgaacactgcattcatttatgcagggtagagggtgggaaaccatacattctgaactctttttaatgagtttgttttttgtagtggtttaagtgaagcaattcgaaaactattttatatgtattatggaagtgagcaaataaagaaatgttttgatgttgatgggatccagagttttcaatgtggaagaagggatgtgtaaatatggagtagaagaaggaaataaagaatcctatgagggtggattgaaattggaggctattgttagggattcagtttttctaatatatatgtgtttgtgtgtacctttcctggttctttcctagctctgtctgctgaaagggtctagaagcaaagacactccagtagcaatgagcagacttagctcccacatttttgtctctaatgccattccccaccaaaaggaaccagggcaccacagagagatagctgatttcaaagctggggcaagttgtgtataacatgagtctggaaaaacgagttgtgccagaaagtaaggaaatactcaaaaagtggtcgagagcacattacaagtacataggagccagcttgaaggggctaccactgaccgaatatgacatgatttgaccaccaattaattaaaggtggtgattaattatagaacattaaaaataggaatccatggtccatttttatgataaatctagatagatgatagatagatagatagatagatagatagatagatagatagatagatagatagatagatgatagagatagatagatgatagatagatagatagatagatagatagatagatagatagatagatagatagatagatagacagaaagacagacaaagaaaagaaggctgtcttgctgagtcctgactggtaaatatagaagttctgaagttggaaaaaaaaatcatcatttcgtaaccatcatagtataaaactggttcagacaaaagaatcatccatggatgttaactctatggggaaattttgataaggagaatgatatgtatttgcatgaccttaaaatgtctctctacattttgctaattggtaagagaaagagagaaatagtaattaaacagtagagaaatgaaaaatgaccttgactgagtgatcaaagttaacatcaccaatgaggggcagatggacaccatgtacttccaaatgccatgccctgagaaggacatcacttaagtggcctagaatgcataaactgaagcgaattatgaggaaatatgagattgccatccggcaaattagatacactctattttaagcagggaggaggctgtatttttttaaatgtcagtatcataaaagaaaaagaaagcctatagaaatgtttcagattgaaggagactaaagatacatgacaactaaaggcaatacttagcctttgactgatcccataatggaggtaaaaaatgctataaaggatattattgagtcaattgacaaaactggaatagggacagcagattacatcaaggtattacatcagcatctactgaaattaataaccaccttgcggttatgtaagaaaacaccattatttctagcaagtaaacactgtaatatttaggagaaaagctataatatatgcaacttactctcaaatggctctccaaagatgcatgtgtgtgtgtgtgtgtgtgtgtgtgtgtgtgtgtgtgtgcatatgcacgctcatgtgtgcgtggaaaaaagagaagaaatggtaaagtaaatggggcaaaatgttaacaacagtaaaatatggataaaggacatatggctgtcttttgcactgtttttagtctgtgatttttcttcaaatttattttcattttttaaaaaatatttttgagttctggcactctgaagatttaacaaaaggaaaaaaatgtggatttttttttcagctgccgtaaaaagtagaagtaattctttaatagaagaaaattcccatagacttgcatagaaattatttaggagttaattttcccattatattgttctcctttgagaagcttccagtgatttcaaacactacagtgattaaaaactcaattggctgaagccaaaaatcacattaataaaataaaaatcaaacttaaaatttaaatagtcaaaaggaagaacatggaaaacacatgcttaattgttacctgcaagtatagttaaattggaattatttggtcaaacatatttacaaatgtcacagagagaaaatgaccaatacaattttgagaactacataatggtttaaatgcttcagaagtataatttttaaaagttattttaaatgataaaacattcaataactttatagaatctttcattattaaataaatgactgtatttttctcttaaaaattttttaaaagcttttttttcttaattttgagtttctggtgattacatttcaaaagagcaatgtgaaccttattgcctcagactatcctctggtacatgtcagcatttttcactgcagcagctcttggcccattcatgtgttcttcctaaagccattatcttaagattctgacatgtaagggacgcattctgggtgcatacttcattgcagtgcacagagggtaaggtaaaggaagataaattgtgtcctcaatcaggctagcagtgcttggtacttgggtcatcttaagttgcttggaacaatgatacctaccacatcatgcaccagaattataccaagaactttatgcatattatctcatttaatcctcgcaatactgagatggggcaataatgtccttggaaaggaagtcaacatatagtgagtttgacctgtgagaagtggcagagccaagactagaatccagattttctggttccaaagcttgtgctctttcatctgtatggtgtattacctccccaagaggtagagaaaccagggccaacaggccaatcttacacaatctctagctcttagttcagatgctacagcctctacaaagtcttccttgaaccccaggaaggtattgatgctgcttttcttattctcccatctcactttgcacataccaccaaaaaaaaaatgataatcttgttgctttattatttttgcatgtttgttttactttctgcactttgatttctttgagaatagaaattaccttttcttctctagattcctagtgactatcatagggactagttcataaaatatattctataaatgctattgaagtcatattggattttaataagtatttattgagcctttaaaagagctttacagcgctctcatttcattcatacagaaattgagacttaacttgagccttaagtcaacagcttgataagattttgtgcaaaggcacaaaatcattaatagaaaaattacacctcattaatagaaaaatcatatgtagaaagagaaagagaaaataagtagaaagagaaaataatgatgagcattttttcatgtgtctcttggctgcataaatgtcttcttttgagaagtgtctgttcatatcctttgcccacttgttgatggggttgtttgtttttttcttgtaaattttttcgagttctttgtagattctggatattagccctttgtcagatgagtagattgcaaaaattttctcccagagaaatgcaaatcaaaaccacaatgagataccatctcacaccagttagaatggcgatcattaaaaagtcaggaaacaacaggtgctggagaggatgtggagaaacaggaacacttttacactgttggtgggactgtaaactggttcaatctttgtggaagacagtgtgacgattcctcagggatctagaactagaaataccatttgacccagccatcccattactgggtatatacccaaaggattataaatcatgctgctataaagacacatgcacacgtatgtttattgcagcactattcacaatagcaaagacctggaaccagcccaaatgtccaacaataatagactgcattaagaaaatgtggcacatgtacaccatggaatactatgcagccataagaaaggatgagttcatgtcctttgtagggatatggatgaagctggaaaccatcattctcagcaaactatcgcaaggacaaaaaaccaaacatgacatgttctcactcataggtgggaattgaacaatgagaacacttggacacaggaaggggaacatcacacaccagggcctgttgtggggtgggggggaggggggaaggatggcattgggagatatacctaatgtaaatgacgagttgatgggtgcagaacaccaacatggcacatgtatacataggtaacaaacctgcacattgtgcccatgtgccctagaacttaaagtataataataaaaataaataaataaataataatatataaaaaaggagagaaaatggatgacctaatctactacagctaatcaggccaggcccagagacttaaactgaggtctacatccacatgaaggcaaatgtaggcaaactgggtagagcctgagagcagtatgaaagtagatggtgctcaatgccaatgctgtataactggagaccaaagggactaggggtaatgacaacttagggagtcatgatggctattttcaaacaccttagtgcattcaacttctctagctgagcaccaacagatgaacttcagctaatgtatagatgtcaccagcaaggattttgtttcaataaaataaaaaaaaaaacattcttttgtacatatctccaaagatggaataagctgcttcaggtaatagtgagctgtctgtcattagaattacacaggcaatgaatggaagatcacatgttaggaaagttttagagtggattcttaaacagaatagtagtctaggttaggggctcctaaattccactctttggactgatgtaaagctaccacaacaaaatataaacaaaagtagcaagtttttcacaatactgaattaattcaatttaaacaactgtcctttatttaaaaattatgctttttggcatcacatttctttttcataatgaaatgagaatgacaagcaaatgccttgacttggaggaaaaaaaatagtttaactactctgtgttggttgccaaaatgtcttttaaaattatagtgacctatgagattcaaaagtgtatcagctaatgggccagataacctctgaggttccttctacccacaagagtgaatgactctacatctcacagactctgaaaactgagtgccagcaaccaggcccagtagaaattcactggttggagtcatgcatgcctggcttcacatcagggtccagctgcttagcagtcaagagactgagcaagttaagatctttgaacctcagttgttttatccttaaaataagaataaaattaaaatgcagcactgcaggatcattggctttggagcccaacacatataggcatgtgtggtaggtaaccaaaatggccacaattctttacatttcttccaccaagaggtgtaatttaattctccatcctttatatctgtgttgaacttgtgctgcttttgcaaaaggttgtagcagaaacaacattctgaacctgagcctcaagtgtctgctcacatttgctgttggtcttggaacactccctgtcttccatgtaatgagctcaggctggcctgctagttgatgaggcccactcactcccactgctgcagtcaagagccagcaaaaaaccagaaaggccactcaagaccagccagtctcaggcacgcctccatctgaacacagatgcaggagcaagcccagttaatatcaaccaagcctgacccagatcatcagaaacacccaactggcccttaaactcatgagtaataataaatcgtagttatttgaagccactgcaccttagggtggttcattattctgcaaaagctaactgatacattttctttccagagtttatatatttcaaagtcctagccaagtgtccttgatcaagttatttatagtgttttagcttcaatatccttacctgtaaaatagacgaaaaattcctacctcataagtttattgtaagaaccaagtgatacattattaaaatatttggcacacagtgtgtagcacatatttaaaagacatttaaaatgtctgttaaaattatagtgacctatgcaattcaagtagcaaataactaatggtaatagtgatagtagaaatagtaaaattataatgccttataaaactcaagtagtgaacaaatagtggtaataatagtgatagtataagtagcaatacttcctccacactgttccttccatgttgattccagctctgagaaatggcaagcaaaccttgtttgaaatcgctgttcatcctgtgactaataagatgtgttatgccaaatttactcagccagggtttgattgattttatattcctgacttgcagtctgaattatttagtaatactgtacaaggtgggtgctagggagccccagaattcagaattttcattccactcttcagagagttaacaatataactgtttctagaggcaaagaaccttagatggccaagagggtggagacaggtagagctagctcattttgaagggtcactgggctggcattctcccaggggctttacatatattatttacaacaatcttgggttgagcattttcatccctgtgtactgatgaagaaattgatttgaaaaggttggttagtgaatttctcatgatagtataaacaataagggacagagctagtattgcacacagatcaattatgttcagagctgttgatccctcctctaaagactcactgtcttcgaaatcatctaagacatctctctcatggtggccccctcatcaccccacatctgttgcctttgcagtcaatcagcccgcatcatggctgtcatctctcacctgcatacttacagtagccttttgtctccctgccttgcaggctcaccctttgacaacggccccactcctgccagagggacccccatggcatgtgggttatatcaaattcccctttcaacattatcccccgtctttcctttacctacatgataaaatcaaaacatggtatggttgactctgcctacctcatcagccacagattctaactctcctccttccaggccacactaagtgactttagcttccatggcccagcatgcttttccctgctaccacatcatggtgcatcttgtgttctgttttacttttcccaagggcttgactttctgacaaactctgacttgatcttcaagtctcccttcaaatgtcaaaactttgtaatgtcttctctgaagtccctaagcaggtttagatcatttccaccttccctcttctctcccaaataaagtaatactcatatttgttgctctctctgtctttcccataaaatcacaaagcagtcatcaccccaaattagttagattatggtgaaaatgttttgaattcatatcttgctaataaaaagggttattatagtggcctctgctgtttagtaataggcaagaaaccaaaatagaaaccaagttagatttcactaagtagttatgagactttgaactatggagactgtcagagctataggtgaacagattcctgataaacacctcatttttagatacgataaagaataactgaaagcaaataaccatatttgaaactgaggaaacactggccacaaaaaaaatgagagaaagaggacaaggaaaatcttaatggaataaatagcaaaacctgcagaaaggcttagagaaatcatttacttcaattttcagaggtgccaagcacagaatgcattttccttatgagtaaggaagaggaaattttgtgagaaacaaaatctttccaaagcaggtgctaaagaaattaaagctcacagaggatggaccaaggccagaattataatccacatggtaaagaaggaaaaggtgtgtgtctgggccaagagcagaaagggattgaagagagacggagtaacacgggcgataccaagggaacctcctggtgtaacctgtgctcatttaaacaaaggcatatccccttcagacctcagacggcattccaaggaacacctacacactggagatgtgggccatccttcagttactccacacagaaatactagcatctattgtgaatagtgccacaataaacatacatgtgcatgtgtctttatagcagcatgatttgtaatcctttgggtatatacccagtaatgggatggctggatcaaatggtatttctagttctagatccctgaggaatcaccacactgtcttccacaatggttgaactagtttacagtcccaccaacagtgtaaaagtgttcttatttctccacatcctctccagcacctgttgtttcctgactttttaatgaccgccttggaaccaacccaaatgtccaacaatgatagactggattaagaaaatgtggcacatatacaccatggaatactaggcagccataaaaaatgatgagttcatgtcctttgtagggacatggatgaagctggaaaccatcattctcagcaaactatcacaaggacaaaaaaccaaacatgacatgttctcactcataggtgggaattgaacaatgagaacactgggacacaggaaggggaacatcacacaccggggcctgttgtggggtgggggggaggggggaaggatggcattggcagatatacctaatgtaaatgacgagttaatgggtgcagcacaccaacatggcacatgtatgcatatgtaacaaacctgcacgttgtgcacatgtaccctagaactgaaagtataataaaaatatataaaaaaagaaagaaagaaagaatagcatcattttgttgcctggatcacagaattgtaaggataatttaattaccctttcttcggtataaagatgagaacgccctcaagcacattcaaaactaaaaccacaacatttatgagcctttcttgaagaaggtacctaataacaaaatacaggagaccagtggtgcttcaaaataaaagaactcaatagaaaagccatggtaaaatggctggtagtgagcactaaatgaattcaagtgttgaacaaaggttaaacaactgtgagaattatggttacaggatagaatacaaatgttataaattccaacaatgtaaaataattttactagaaaaacccaggtgatgcaaggagggcatggggagacataaactagtattctcatatttcagaaaaacactaccattaatagataataacgaatttgaaatattcatttaaaaaatttttttctcatccccttcatgtgttttttttttcagtttttttctttttttttactaatgataattttattttattttatttttattacactttaggtatatgtgcacaacgtacatgtgcccaacgtgcaggtttttactgtttttcttagcctttgaggtacctttaaagaatgacattcccttgtaaagacacaatctgaggttcagcaattcattctgtttcttccttccattcaattcaagaaaaaatgttataatttaaatgatctgcatataaaaaatcccatctttataaaattatttgtactcagcttaatttgtgttttcaaagacaggtgtacaaaacaatactctataaaaatcacaatgctaatctcttggaggaataattttttttttttgaaacagagtttcactcttgttgcccaggctagagtgcagtggcacgatctcagctcactgcaacctccacctcctgggttcaagcaattctcctgcctcagcctccctagtagttgggattataggcatgtgccaccatgcctggctaattttgtatctttagtagagatggggtttttccatgttggtctggctggtctcaaactcctgacctcaggtgatccacctgcctcagcctcccaaactgctaggattacagatgtgagccactgcacccagccgggaggaagaattttagatgagattttactttttttctgtgaacttttcactagaaccagattctgtgctggtttcttgatttttattcttagcatgtaccatatttgggaaaaaaatagcaaagatgacattctttttaaaaagattttcatacaattttaaaaaaataaaattgattttggctcccataaccactctggttggtttgtgacagttgtctggaacaccatgttaaaatggattctgagctccacagaaaacaattatctgatagatcagtaaatctgccatggccgccaagaaggagtgaggtcatacagcctatatgtatagactgtggtcatacatacaatcatatagtcaacattccaacagtctaataaaaataagactgaaattttgtgtataacaattaaagaagtcaagtgaggacagctgtctacatcattcactcaataaaagttgactaatccaagacttacataggctagatagtttacatacatctagacagtacaatttataggcaaccataaaaagaggaaaaatgatgattgtattatactaatctctctattagcaaatatataaaattgctataatataaaatagttaaaaaacagaaagttaggaccgaattaatgtagaaccctctgtcattctaagaataagtagttttcattcatagatacataaactatgtggaaaaaaaggtccatacatatccttgagagaggccttttcaataaaattctaattttatgtttaataattatttgtcaacatttataatgtatatggtatttttatcaaatgggaactatgaataattagagtgataacacaatccagaagagagaatattaaacttaattctggatggtaccaagatttttttaaaattatgtttcaaagagggaaaaaaaacacacaagtaaagaatgagtacatttaaatgatttcatcatcttgtcaccctacaaatgcttactgaagcaaatgcagaccaggttctgtgctggttgctggaagcatagagataaatgcaacacggctctggctaggaagggaaacagggcctgagaaaactgtcactgtcacgtagttgaaaggaaaaccaggagagaactgtggcaggaagaagttttaaaaagtggccaccaaaaagtgataagttggtgaggtgacaaatgtgttcattagcttgactggatctttacaccatgcatacttagatcaaaacatcacactgtgcctcatacataaatgtacaaaattattatttgtctattaaagatgcatttacattttttaaaataaataaatttagactacaattatggttccataactgaaaatatactaaaattttgagatgattttaaaaataataatcacacatgactggtaagctctgcagctgaaaggaaaaaaatgaggtgaaattgagactgctattaggcggtcactgggtgtttcagtggagcggtaagcaaaattatttgttcttcagtaatctaggactgacttgcaaaaggctatgattaagttaaacattttgtattcacaggtcacagagtaagggacatttaatggagggtagggggatctctaaacccacctcagtgttatccacatctagaaaatcaaatgtacaacacagatgctgggaatttctggcagggaaacctggggccagagaggagagctggctcggtggacaacaccagctgtaagcacactccggtgaattttcctggaccaaatttcctgggatccaggatgaaaggaggttttagggctgcctagcaacactatgtttatacaatggtccaagaacatggagagaagaagagcaaaaatacaaaaatctgtttctggagaggggctgccagggtgactatcaggcggccccagcctggagcaggcctccccaggccgagcccgggcatgtgacacccagactccgcaggctgtgtgacatgggaaacaggcctggtgggtcccagattgccccagcgcccgccactaatcacagccatcctcggcttctccattgttttcacagctgttcaaccgctcctgctcagtaaggggacagacaggccgactccaaatcatggagtagaaaataacactctgtcgccgtctcaaaaaaaaaaagaaaagaaaagaaaagaacactctggccaaagaaagggtgcacaaaaaaggattttattggtgggggcggggcagggggatggtgtcagggagatgggaaacgtacaaaactcttaacccttttattggcttgatcaaatgtgactgttttcaaaagagaagagacagaattcaaattgttttgtagttcaacattttaaggattagatttttccaactgagatcatatttgcccataaaattaccaatggaaatggtacccatttctccaggcaagaccacaaaagcctacttaattatccatgtatttagttatactcaccaacctgagagatgagaacctagatcagagaacagagaggaggaaacaatattttttaatatgaaaatgtatagattgcttgctgtgtactcagtacattatgtatacaacatcacaatccacaccctcaagctatgaagtaggtaattacctcattttacatatgaggaaactgaggcagtaacttgcccaaagttacagagctacaaagaggcagggacattattgtaagagaggcaatctaattcacaaatcaagagccttaatcactacgttacactgcttcctttaatacctcgatattggtttcctaaggctgctgtaatggattaccacaaatgtgatgccttaaaataacgcaactatgttatcttacagtatggaggtcagaagtccaaaattagtttcactgagctaaaatcaagatgttccttctggagactctaggggagaatctgttttcttgtgttttccaaattctaacagctgccaacattctttggctcgtgacctccttcctccatcttcaaagccagcagtgtagcaccttctccctctctagttccaaacttccatcttcactgtctcttataaggacccgtgactacatttaaggcccacctggatcattaaggataacctagccatttcaaggtcttaatcatctttgtgaagacccttttgccatgtaaggtaacatattcacatgttccaaagacatgaggggtcccttactccacctaccacaacccctaataatgtatgtgtattttaactagtacagtcaccatgccatgttatgtatgtgtatacatacatgtctatgttctcctcacaatcatactgcaattgttttcaggacagggaccatgttccactcatctttaaatctttagttcctgataaacacaaagtaggcacccataaattgttgtatttgaccaatgaatgatgaataaatttcagtatgacaattttgagttaacatacatgtcatttataacaaaaaaatgaacatatgttgacggtcagtaaccaacatcaagtgtactgaatggttctctcctcctgcccttaccaaatcctgctgtgataggcctctttcctttgctcagactgtcctcctgccttggatgtccttcctgcctttcttgtcttgattaattcctgcttgtcctttcagactcaggtcaggggtttcttctcttagaaagccttctctgacacacacacatacacacacacacacacacacacacacacacacacacacacctggctggaagtagctcgctagagctgcttgtgcatattttgtctccttatttgaaacatcccgttgataactatggtaggagtatttacaccacagaaattggcaaatactacaactcagggtttttccttccagaaagccattattaaatatttataccacacaccccatggcttagttcctcactcttgacttgtataccaatagtgtcccccctacttacctctaccacactattgtctcattgtctttgaaccttttatttatatgctggttatccacacttgctaggtgcccactaaaggcggaaactctttctctctttctctatgcctagcatacaacaaagttcctaacaggcactagattttcagtaaatatggaaaggacaaataataatagccataacactaatcataaaaatacagctaaaatttaattcactcttacttaccaaatactcataactaagaagtatagtatgactcaaggatatacagagcaaggttgttttatttttttctagtaactgcaattgctttttcaacaacccccaccatcatatactagtggaagggtggagttgtgggaatggtttggtggtacctttaagttgccaaataaccatttgacaatatcttagtccttccaataattcaacctggtccagcagtctgtggactgatccagttatagcctcaaattcatttcagataagcattcaatcccatgtagagattagcatcctccttccctgcctcctgcattaagctgctgcaagggccattgagacagaagagaagggtgacttgttcaccccagaccattcattttgatcatcttgtactttttctttctcctccctgttgtgtgctaacatgggggctgaggtggtaagggggcagtctgtttcccaggagaacgtgcggggcatatttatgagttctggtgacctttatcatttttttctcactgctcatctactcatggtctctatattcacctgtgacaggtaggcactaattgttttagccagcatggacatggccttatgcagtgacgcccaagacactgtgaaacatcttcagtctgactccagcccataatcttcaatatctgcagtagtctctagcaaatgtgtagacctccaatctcctcgccttcatcatcctgtacacaaggccgatggaagcagatgggattttccactgttccttgagtgggatggtctttgccccttcttctgtctccaaactccaggatcctaggggtatgtctgaaacctagcaaacatccatctggagaatgagccacaagattttttttccccttcttgcagaaactccaacaatttaattagcaaggggaaaggaggctaactttaacatcttccattgaagttcttcaccaaagtaacttccccacccagccacccccagattcatttgtttagaaatggggatgggaggttgtcatatagtttcttttagcatatcatgctctgcaaaacctatgtgtggccaggctgtttctttgactttagaaggtgaagcaatagcatctttattcccagctgtgagccatctcttcactagtttacttcttatatttctgtgtgtaccaagtactatgataagtattttataggaattatgtcacaacaaagtaattagactctttattacagatagggacattgaatttcacaaaggttacatcatttgctcagcatcccaccaataataagttccaaagtaaaattcaaacacaagtttgtttaaataaaaaacctaggttctttaccactgctctcttccaccatctcaaatctgcactcccaaatctgtcctgatttgtggaaccacctctgcctctccaaaagtacctctcacttagcttacattgttaagtatccttttaaatatatgttgctgcctggaagacaagctcattagctctttttattataaggtgttttttttgctcatcactaccaagaaccagacaagggggtcatcaaaatagcaaacaggagaaaatttaaaattttaagtaattcggctgggcacagtggctcacacctgtaaagccagcactttgggaggccaaggcgggcagatcatgaggccaagagatcaagaccatccgggccaacatggtgaaaccctgcctccactaaaaatacaaaaaaaaaaaaaattagctgggtatggtggtgcatgcctgtagtcccagctactcgggaggctgaggcaggataatcacttgaacccgggaggcggaggttgcagtgagctgagattgtgccactgcactccagcctggtgatagagcaagactccatctcaaaaaaacaaattaattaaaattaaaattaagtaattcaccaatctcctgcagggcttgccacagtctagttaagaaaagtgaccagctcatgaagatcctgccaaccctgaccccaagaaaggccttggcttccacaatacatttaagtgcctcacactgacctcccagaaggttctgggcccccactgaacaaagagaaatatctttgcaaaaccttctactggtcatatcattgagagggactggcgtttgttgcacttccagctgggattcctggtctcacagcttccaacgctgcacccatccatgaccctcactaacccctactaaaggtcacattattagagcagctccctctcttccaactatccagaataagccacatgagttatatccagaatctttcttgcctcactcaatccagacctaatcatctatttccagatttatttgactgagtcctatccagactctacaatgactttgaaggtcagattccacctcttcagtaagagaaagcctgagactatcttatctcatcatcaaagagtgaagaacaatcccaaaataagtagaaacgcaaaagcttataacctctttttctcctcccattcataagacattccaaccacaaaggttctgggtaaaatctcaaaaaaaaaaaaaaaattcagtcaaaagtaaaatcatcatttcaacaaattttttttgttttgaccaaatcatctgctccaaaccaccattgccaaggccacttaatgcatttggcactatgagctcagggcctaagacttgcatgcataaagatatatttataggctccaaaataagaaacaaaaactgcagatcaaaatgaatgaatgttgaattaaatatctacacaaatttaacattttgtcagctattagactacaactcaacttatatggttattcataatttcatgaaataggacatgtggttgcattttaatacatttgaaatgatcttgggtagatcctccaaaacaaaggctgcctaggatgctaaagcgtctctgcttagctccgtggaccatggtgtgtccttgaacaaattttgagttcatctcctcttcaggagcgaagaaaggaagcggaaaatgcaataggccttcacctttaccaaaggttgcagggtgtcccatcatgtattccatactgcgtcccatcccctccccctgcagacactcaggcctgccctaagctcttcacattgtgggctaatctcttgtctctatcttctctagtcttcatctgggtacctctattcattgtagtaattccaggtagaggaaattacaagctttatttatttctggtaagtaacttcaccttagacatctcccaaaaggggaacacccatctcaaggagccaactgatgggcaaaaactgagagccacctatatgcatataataatgacacacataatatcaatcactttgtgccaagcaccattctcaacatttttcaattataccactgatcccctaattatacttatttttcagatgagaaaactttagcagtgagagtagctatcatgcccaaggtcacataggcagaaagtgtcagaggcttgaccgctacattggcccattatgttatgcaggtgggaagaacttaagcctggaacccaaccctcatctgaggatggcagatgaaaccagggagcctaggaccaggtatcgctgaacaacttcttgagaaacacatttatatctgacttacatcataggatttaagggctcttcatcagagcagctcagcctgttctctaacacaccttgtctcacagccttccaagaaagcacgcccagcctatttatttataaaatgccctccccatgacttgccccttctctctgtgtgtgttttactcatctaaattctacctgtccctccatccttggtttatatcccatctcatctttccaattccagcacctggtaaaccttgatttttctgggcttctctaactaacactgtgtattgttaccaatctcttgggaatttaatcacacatggctggatctggctaaccaatttctccatttggtaagtctcatggtcccagcaagatttgagaaaaagtccttgagggcatggagttggtcttagagaacacacctctggattcctttcgcctgggtttacatttctgctctgtatttatcagttgtaagaccatggataaaacacttgatttttgtgtgcttcaatctcctcaactataaaatcagggtaataatggtatctaactatagggctgccaggaacagcaaaggagccagtaattcatggaatcctatataggatttaaatagagttgatgatgtccctaaatttgtttttaatgatttaataattacattttaaaatctaagtatttgactgtatctttcatgcttatcaactgtcatttataataagagtaaacaaaaacaaaaagcttactttttgcaaagaactgggctaagtatgtgtctggttttttccccaccaaccttatttgagccaaggggattgcagagggagaaaaatacatgtgcaagtatcacatcactttatttccagaactataaactatggaacagattgcatttgcaatatttgtttaaaataagcctttagtaagttatatccccagagactagtcactgcaactaacccgtcaaaaataaccacagcaaggaattggaggctcctgatataatctgtatatttataggaggcttcgcttcaaaaaggtagctccaaccccggatctcaagacctttatttgaactcttggctgcagcataattgacagagagaattaaaggggatatgaagacctgggactgaactttttcaatagtctcagctcggctcacgttgctcacgatattagaggctgccgtgatgatattaaatgatgccgcactgacagagattaacagagtaggcaattagatttaaatgctgtaattggaacatgctgttaagtgcctaccatcagtcctgggtctccccttatggcaagcgagtctctccttgggttgctctgtaaatttaacactgtcctcaccagcaacaaatcctccatcactgatgtacagagtgtgaacaggcctgacattattatgaaattgtcatgtatcttctacacgtgtccataatacttgaaaatttcaaaatgctttcaaatccggttaggtcttttgggctttatatacatttgtgaggagaaaagaatcatattgcaaaggatgtaattgaggattgatacagtaaaaagacctgcccagggcctgctaagctactctgttaatgcatcaagaatctaaattatgtcctttgacttccatgtgcttttcatcatgccatggtgcctccataggttgtaatttgaaattaaattctgcctgctgaacactattctctcagaagatgaagactctcagccccacaacaggacaagctaccatattttgacattaccttcatgcctgtaggtcttcaccaacaatattaccttcactaaccacagacaataccatagaatgaggtaatcaatcaccatgtgcttgctgggtatctgatatgtgtcaagacatcgatacacaccatatgatgattataaaaggggatcttaaaatttcactatttctatccatgtgactcaatttgcccacttacgaagtataacaactttaaaaaaatagctaacatttgccaagataattacaacatgccaggccttttatagatgctctctatgtactaacttttgaatttttaaagttggctttcaaactgtcattgcagtaacaggattccacagtgttgctatagaggttgttgcaaagtggaaagggttaactggatgagcctctcggtccacaccccaaacttcactcagaaagagaaacgggaattgtggtgttttctcattcacatatttcagatatagggtttttagaaataatttatatattggttcaaaattcaaaaagtagaaaaaaaatgcatcaaatgaaaaatatttctcccatttaagtcccccagccacccagtatagctcccccgaaaggaaaaagcaaaaaaaaaaaaaaaaaaaaaaaaaaaagtcactgctcttattaattcttcagatgccctttcaaagatgtttttaataaatataagtatttttttccattttccttccataccatatacactgttttacatcttgatttttcacttaaaaatgcaacttggagatcttcctataacagttcctaaaaacttcagctgcataattccatttaaccagtcctctgttgatgaatatttaggtaatcttttgctgtgaagaataatgttacatgtgtcatttttcacacaggaaaatgtactgatagtgtaatttcctagaattggaattgtaggatcaaagaatagatgcatttgtaattttgtttgatactgtttaaattgtactaatttacctcccaccagcagcatatgagtgttaccacacagtcttggcaacatcaagcatcaaatgtttgaatcttttgctttcacttttataagaatctctagttttgaattttccttttatctggcctatctatgcatatcctttgcccattttttccagtgggttgattatcttttccatattgacttatagaagctatttatatattaaagatattgtctgtgacaagttgcacatattttgcctcggatcatttgtcttttgactctgtttctagtacttttgcatgcaaatactttaaatatataaagttggatttatcagatttttcttgtccagttattgcattttgtataatatcgaaaagatgtttctcattcctggacaataaaataatcctcacatattttcttctactacctttatgatttaattttttacttttaaatagttgattcatttggaactcatcttggtgcacagtgtgactgtgaatccaattttttttccaaatagttacccatctattactattacagactagtctgccccccaatttcaacacaccactgatttgagctgccaattttattatatacccattcccctatatatttgaattccatatatatttagattttttttctgttccactagttttacttatcagccaatatctcatcgttttagtaaaggtttattatatgttttaatattccctaaaataagtgctaccttattgctcttctatttttgtgttttctggctattcttatctatttcttttaccataagaaaaaatttataaagattttatgtatttttattaaaattatattcaatttataaattaatgcaagggaaaattatatctttatttggttgagtcttcctatccaacaacgctgtatatgctttctatttgttcagctcttcttttgtgcaatttcacaaatatgctgtgtatgtgttaaacacgtatagatatgcacacatacattcatgtaggtgtcaatgacaaagatgtgttctgagatgcatccttaggcaatttcatcattgtgagaacatcatagagtgtacttacacaaacttagtgtagcctactacacacctatagctattgttcataagctacatcctggtgtggcatattactgtgtgaaatactataggcaattgtggcacaatggtgagtatttgtatatctaaacatatctaggctggacatggtggcacacagctataatcccagcacttttggaggctgaagcaggtggattactttagtctaggagttcaagaccagcatgggcaacatggcaagacactatctctacaaaaataaaaattaaaaaattaaaaatttttaaaatcccatatctaagcatagaaagggtacagctaaaatatcatattatattcttatgtgaccactatcttatatgtggactgtcatatatgctgtccattgttgaccaaaaacagttatgcagtgcatgactatgtgtatatgattgcacctatatgtacatgtaatatatatagtttgtatgtacatgagacatttgtgatgttgcattagttacctttcattatctctggagaatgattatagagattttgtcattaggtctattaatatgcagatttttattaatatatgtccctatattgattcatccttatattcctgaaataactcatcttcctcatggtacagtattctctaatatgctgccagattctgtaaggtagtattttattgggaaatttcacatcttgattacgagaactttttttttagtgtggaaacattgactacatggtctttaaggtctctttaagttctaatattcattgagtaaactccaagacagtatgagaacaattaaatgccacattgttttcataagttaaaaaagtaattaaaagaattcctttccattctctgtgctttctacagtgtccagcataaaatgagtgcacaaacaatatttattaaataagtaataaatgaataaatattaattagacactggaaggcccacaacactgtgcaggatacaaacaatgacttaaagggttccagagactaatgtgatgaactaggaaagaacatggaatttggactcaattatacctagaatctaacctcagctctgttcccctgattgatgaaagatctcacacttgatacttaactcattgtccttacctgtaaaatggagagaataatatatagcatgaagttggcggtgaacataaagtgaaatagtctatgtaattggcaggcatattgcttgatgtataacagattttttaaaaactttactttcctgtctcatttatactctccctccatccttaagaacacatgctctagtacatgcatatgtttttaataatgataatgataatgaaataaagcaagaatgcacacaaacacaaagtcacacaaactacagtttaatacggcctagggctgtggtgaagcatggagtccagagccagacagaaccgggttctgaccccaggtcagccagcatcttactgtatgactgtgggcatgtcatctaaatcacatgtcatctaaatcttggtttccttgtctgtaaaatgggaatattacttactatttcatacacttggttcgaaaactgagacaatacatataaagcacctagcccaaagcagccatggtaccccagtgtcactgctctttcctgatagttgcgcagctgacagctgatatacagattgccactggctgcctgagaattctcttcggtcagatctcctcccacagagtggagaattccaactgtctagtcaggagacatgacaatgggaagtcccatcctactccactttcttccctgacctccaatcttcccagtcatacgggcccatcattgtagcacttaatcatatgctgtcatatgtggttactcgacttgttggcatgttatgttctactcacctaagcaccctatctcatgctgtccttttctctctcaaagcatctttcattggcttgaactcagcaccagcaagcaattaaatgctgtaaatcatataattttagggttggaaggttactgaaaagtgtaatatgtgagtcccctcaactacagttacttaaactgttgaaaaaactcccctgaaagattctccttcccaccacagcctgtcccactggaatgttcgctcccaccccagggcctttgcgtggctcttctctatgcctgaaacactcttccccacttcccttcttcctattttttagtcctactcctgtgatatttaaaaattgcaggcgatttgcctcttcctctgggaagccttccctgagcccaggctaaaccaggatcccctacaatataccattttagctccctgcactctttctttattgtagttatcacagttagtacttattcacattggtgattatttacaaataaatatttttttcacccactaggctgtaaaatgtataaggccagatgcaagtctgtttttgctcatcatgttttcactagcacctaattctgcacctagtctgcagttcatagtttttaatagatgtttgttgaattaattggttaatgaattaaacagctcctaaatacttcccagtaaggatatatttttacactctctaaatcactggatcctcacctcagctcagtcacaaagtgagatttaatcctttttctctctctccaaatatcttaccttgatgtccaacagcttactactgagcatctccatttgatccattgcttgggaggaatctcccttttcttccaatcgtgcggtctaccccatcttgtttccaccccagcccccagtgtgcacaccagacacacacacacaggtacacacagactgagggttccattaggcaacagcaggttttgtgtgtggcttctgtatgatataaatactttctctacattcaagtgtaatgtgtatgaggccatgatcagtcttagagttctctgcaagtctcaggccagtttgccttcacacccattcattgcctttctcctctctctaccacagtggctagaggagactagacggcaaaaggaagggggaggccaaagcatccctcatctggtctctatgcttaagagccgcatcactgcattactgccatggctccagctcccatctgccaggcctgccatggtccagccttctctggtgacctctgccccagggcttcagaaacactctctccttttagtctggactacaggaagcagggacttcctgctgtggccttaccagctgtcactgacttctcctcttttccatcatccacgtaaccaattccctacatgaaacttcctcaaagtggttttttgttttcttaaaaaaaaaatcacatggactgatacatgtgaagatgacaatagaaagccagagcagatttatcaccatttcaccttgtggttatttgtatgcctttcattgccaccttaggaaggaggcaccaagtgttatgcatttactacattaccacaccaactcccaaagcaccttctacatattaaaacatccatgaatatttgttgaatgaatgaatgaatgaatgaatgaatgaattgaacctggggagctgtaatatcttaagtgtttaaagcttctatgaatatcataaagttatacattaattagaatcagtctatgagcacctttctcaataacacacaaatctggaagtaatgtaattaattcaaaattacataagtaatcaaggtgtgcttacttttccatcaatcaaggcataattacttagctgtgagaaagctcaaaaggggtttatatagcctttaatgaggcttacacagcatatgacaactcaggaatgagcagagcattgtaaaagctactagacaattaaagctgcttaaatatcatgcgtgaaaaaaatgtctactccttctcagacactattataatttttctaacggaatgtcttgagaagatgaccagatctactatttgaatgcaatttctatgtcacacgcacacaaactagatagatacatagatgatagatagatgcatagataaatacatagatgatagatacatagatacatatacagatgatagatagatacatagatgatagatagatacgtagataaatagataagtagctaggagagagatcgtggcttagcttagctgcattcccttgaaaagcagaactgagaaaaggacttgtaataatttgtttaggaggtaatacagggagcaagagtgaggtttgggagtagatggaggaatgtggaaaaaggaatgtatattcccagttctatcttctatctcttgtattatgtggtttcaggtctccctgtcatcatgcattcattcattcatctaacatttatcagaatgctaagtgccaggcatagcacctggtcttacagatgcaggggaatggaagggcaatccctgccctcatggttaaaatttagctacaagatccagcttttgcttctggaggctctaccttcaaggcacttcaagccagcagcatgtctcctccatcagacctcacgggatcccctggccccctgcattctcactccccacctatagcctgattgtatgggcccccctcctggaattccttagcatctcatgtattcagatttcttcaattttgtttttctagaatccttatgaagatttttaaattctagataattttttttaccataaataacagtgactcttccctcactggcaaaatttgaacagcatcctgcagcatcagggagtttcttccattccacttttcagtatgatgtatgcgtgttaagggcttaactttcagaccaaatctctagccagaaataatcactccaaagtgagcaggagacagggtaatatgtcagccatctctgatactgctgaaagtagctaagaatgttctgtagccctcagaaaagaccactggttcaaggcatgttaaagccagaaaggaaaaactctgtgtgtcttgactttgccccacctaaagttatgcagattaaaaaaaaatgtgaccagggtagcactgtagaaagagcctggtttcaagatcacacatatctgggtccaaatacctactcagccacaaactctctgtgtgacctcgaccaagttccttggcctctctgagtcaaagtacttcacctatcaaatagaactaacacttagctcacagagttgctaccatctttgtggagtttttttttttaacatgaccttttagctaataggccatattagctaaaattatagtcccaccttcaaacactccctatctctcatccttacttttacttttcttctttgcatttaccactgtctgacactccatatatttctatatctgtatctctcttcccatttgtgtgttgccaccactataatggaaactccaaaagagcaaggattcttgacttttcatgtatttctaatccttagcacatatggggacttagtaagtatttgttgaatgagtaagtatttgttgaatgagtaagtatttgttgaatgagttagtgaatggatggatagatggatggatggatggatggatggatggatggatggatgggcaagtgaaacattaaaaggtactcattaaatgttagctgaatgaagcaaagggccatagtctagctcccatagctggcacaatgatagtagtaccaaataaagttactaacaacaagctaatggtttccccatggggaagactaaggtttgactgagacttgaatgcaaagtgcttttttattaacagcataaattattctggtgagtatcttctccttagcatcctaaattttttacaagtatccagctctctgccaggcagccctacttaataacaacttctgacccttgaagagcagtttcctttgctcaaagcactttcagatatatattctattaaaactccataatctttgcaggaaaaggctcttcccaccacttctatcttgtgtgttagtaagagacaaagtttacagtagagcatgcctcaaagagaaatgaggtcaccaaactagagaaactgtgcaatagcaggttgggagtaaagccaagaataataataatgcctgttactattaataagacctaacttttaaccctcaggctgacacagcctgagattcagcatgggttgcacagagacagtgcagtgggagaggaatgggacatttctagtcatatacactgactaacccaagactggcagtcagtgaaagtgatgggtaaatggtccttgcgacctaataggagttgaacaagtgattctctagtgagtagatgaatggatgaacgaataaaatatttatttgtttccattcataaatacttttgaagcacctctgttgcatcaggtcctgtggtagatgcggggttacaaagatgatcaagacatgacagaggggcttgggctacacctataagacttttttagactttgaatctgtcttcaaaaaaactaaagcccaatatgcaaaacagttcaaaacttacctgctccaaatcacagcaggctgtgtgtggtgggaagagggaggaaagggccttcactctggtggggtgtctgaggaagccctgtggctccccggagcattactcaaaacattgccttagatgaacattcaggtgcttctgcaacagagatgccaggattctgtggatgatgcattaagcccttgtaagagagaaggttctgaggtttagaagacaagaaggaagggttcagcactcagtatctacagaggatgttgctagagggttccttggagaccaagggttggtgaaggctgaggctttgaggcagaaaactgtcatggacattagtcatttttgttgctgcccagtatgagtcttgttgtaggataaaattgcttctccttaaagaggcagcaatgctagatacttgctttcctggtttcatttgcatctaaggcacaggactgaatcaagatcttagggacacaaggaaacatgtctctccttgcgttgcctctctgctctcttctcccttcccctctcttaccctccccttccgtctcctcccttctcctctcctatcctccctttctccccacctcaatgtctgaggttgcaatgtcagaccctgacacagtcaagcaatgctgggggatcagggagcactttgctcatcagatcattcctctccagccctcacctcacacctgctctgcagctttccaaccgttctgtgagctgcccgataccatctaataaatttcttctctcctttatcagcctgagccagtctctgctgcttacagaccaaagccataagaggcccaggacacaaatgggaagactgggagataggcatgcttattcttccttagaagctctcctgaaatccaagctgaaaactggctccaacggggctgcaaaaaaaaaaaaaaaaaaaagcactgaaaagtttccagtagcgtcaccagggaagagtcccaggttttctctttcaatacacagctttaaaaaatgaaaagatttcctatcctcaagcctctgtatttatattttggaaactgtcagcaaagacagaggtttcttcctgaccagaactttggtcaatctaagagtcagatgttctgaggagccatttttcatgtggggaactccttaaagagaaatccaggtggctgtcagcctaatagccaagttgttgacaaagcacaagagtttctgatatttcctggacaccaatccatattgctttaacagaattttgttgcattgaagctgatattccccccaaaatcattaatccagtctcagctacttctgttggttggaattgacttggcagctgtacttagagaggttcagagaaaggaaaatattctcctgtgttaattaaacaatgttgactagaaataaagacctagttagggaatcaggagttaggaaacgggagttcttttcctagagttgccagtttccattttgtgactttgatgttccctctctatgaaatggggaaaatatgctttatgagattctcgtggagatataaccatatatatatattctcgtgaggactgaataatatccacccataaagtttcactgctgttattgttatttctttctcaacattcttaatataaagtcagaagcaaggatggccagagatgctgggaaaggcatatatacggacggcaaagaagagaagctgctatgatgagaagaaagagacttggagtcagaaggttgtgcttcccaccagctgtgtgattgtggacaatctatttcagcttcctgaaactccactttctttgctatagcatagagattaaattgtgaggattaaatgcaataactataaaagtcttgagtacaatgcttagttcatagtacatgctcaatgttaatttccttccattgttccctgcttatcaaagaagagagaggcttacgtacagagaagtaaaccaagagttggcaaatacagccagcaagctaaatgcgcccaccatctgttcgtataagcaaagtttttttgttttttgttttgttttgttttgttttgtttttgagatggagtcttgctctgtcacccaggctggagtgcagtggcacaatctcagctcactgctgcaacctccgcctcccgggttcaagtgattctcctacctcagcctcccgagtagctgggactacaggcgcccactaccatacccagttaatttttgtattttaatagagacagggtttcaccatatcggctaggctggtctcgaactcctgaccctgtgatccgcccgcctcagcttcctaaagtgctgggattacaggtatgagccactgcacctggtcagcaaagttttattgaacacagacgtgctcatttgtttactattttctatgaccactttagttgttacagagatcacatagtctgcaaagcctaaaatatttactaccgggttttttatagaaaaagttttccgacccctgacctaagctactcaagtccaatctacacacttaaagctttcaaaacataaaattaagacaatttaataatttgcctaaggtcacaagggtacttggcaagtgaatggcaagctaatgaatgccccctactgggcagtagaggcgatgttatgcgacatggttaacagctcagactaaacatcgttcaaatccaggctctgccacttactagctatgcaaccttagaggagttgcaaacttacctcacactgtgactgtagtgttaataatttgtcataatgactcttgaaaaatgacatcctttattgtacaatgtcttctttttatcactataataaatttttttttacctaaaaacgtataaataaacaagatataagaagtgaaattttgacattggtgtcacaggcaaagacataacccttatttactcaacacaacagtttatctcggagattaccagatgaaacaaatctgaattgcacaccacttgtggatgagctcagtacagcttgctttttgtacaaatgtcaagaaattattcagtctgtagctagagctgtggggttcagagcagtgtatatcatatatatacccctctctttccagattttcttttattagttttgatacatttcagagagaaacatctctgccttcagatccccagggcccttctttcacaaagccctgctaaaaagaaataatctgaccttagtgttaacatatcaccatgaagcaaaatcattcattgaatattaacaataactcagtttttctgtggaatagttgtagaggctttctgagttttaagcctttttaatcattgtatacaatttcaagaggattttacttttttcttgtagaaaaaaagaccacaaaaatgagaaaaatagaggctatttattcaaggcttactatagcaaaggaatcagccatcgtcacttccatttggcagagactcaaagtcaggcagaagaagcaaggaaagctttatagttaaaaaaaaaaaagagagagagagagagaaaagggggagtgttcaggtatgctctaattagaagttgttggcatggggaagctggagacaggctataaaaatgggatatattatgtgatttttttttttagggagtgatatggtttggctgtgtccccacccaaatctcatcttgaattgtagctctcataattctcatgtgttgtgggagggacccagtgggaggtaactgaatcatgggggcaggtcttttctgtgctgttctcatgatagtgaataagtctcacgagatctgatggttttataaagaggagttcccctacagaagttctttcttgcctgctgccatgtaagatgtgcctttcacctttctccttccaccatgattgtgaggcctccccagccacgtggaactgtgagtccattaaacctctttttttttaatataaattacccagtcttaggtatgtctttatcagcagcatgaaaacagactaatacagggagcatatttggttttctctggttggtccggaattagaagtgaaagccacaaataggaaagctggcagtcattgacgaagttctgactgtttggggtcaattgatgtgaaggtcatgatttgctttccaggatcaatagccagaaaggttgttggtcaatgttctactgccatatatgatctggtcactgtctagacaacgtccctcagtcccccctttcagtcattctctcacttgcaacaggttggtcaattcaaggaagaccagaaatgcagatcttcactgatggaaggttgtctgcttgtctccatagtcaaccgtatcacaagatcttcttgatctttttactgctgtatcatcatgacaatcatttgatgagagagctgctacacaaaagcatttaagactctggatagaatataatgaacaagcttacaacaactttgaccaaaacaaagacaagtaatagtcccactaagacagctagacccaggaaccccaattgcctaactcaggtaaacagaatgaatcccagagcccaagaggatgaatcttagaacatcaagtcactttttctttaaggtgaagtgtagcctacttgactatgcctgcttcacagatctaagtaaataagaattattaacaatgatacaaacaccacattgactagccaacaagaaatttagagtaatgacattgtccatcattactcctgccaacaagttgacattgatctgtactctatctaaggcagaaggagtacattaattaataacttctgctgagttaattctaagtttctttcaatattttctacttgtttgagtctcaccactgggatcattcctttcattgttcccataaacaatgagtaagtaattcccccaaatggaggacttacgatggagctatcaactaagttagaatttccagccttggtgatctatagaattagaatctctgtatactgacaggtcttagaatattatttctaaagtgcagaagaaaagatgaccgggaagtcctagaagtatatgatagtggcacatggacacttaggaaaaaatttagttgtttatggcatgaggtcagaatcaatgctttattttagctgtgtcacacatttttatctttactagtctcttccaagtggcaagaatttggccaattaccttaagaaagttgctgaattcaaatttatattacctaagttccaatcaatagattgtaacaatgtactccttttctgggggaaagaaggacactggcaaagttataggttggttcattttagtacatttgtccttgtaggtgcaaatggaaatgcaatcagtagttcctcatggcttcatttggtgagactgaaattgccctaagatatcatgggggtccattgattaatggcatatccaaaagttggtaaagttgaaggcagggctatggtttggaataatcaaagaatgagtttgaatgagaatgttccaacctaatagttatcataaagatgaatgaaaataaaaaagaagccattatgggtggacaacaatcagggatctatagaacatgagaagaaaagtgtttataagcaagcagatgaaaaacaaaacaggaattatacaggggtcttggtctggaggggaagctgtccattatctgaggtcataagattgttctcatggtctcaggtcagaagactacttccaaagatcacctgcttctagagaatctctgaaaatcttgtttgagggtccatattaacatataatggccttccaattgtatggaattctgtattgttttttttcattgtaaaacagaaatccaaggattaatttccaggagttccactcctgcatttgttgttaaagtaccttccaatgaggtttgagtgcagtttttctattatgtctcttccggcagatgaaatctcctcattgcaagtcatgaaaactttgcttagttagatgtgtgagagaatggccttaaaatattggtggtagaaatggacacagtacttgagtcccttgcagtattttgccatgtcttcatgtgacagggcagaatctagtattaaagatgaaatctattaattcatgatgcttctagttaccagttaataagggaataactgattgtttgcaagggagtggatcatacggccataatggctagtagaaatacctttggtcaagaaagaaaaaggattattaaaaggttttataagtatgctacttttaatttaagggtgccattggttctttctacctttccaaaagatttggatggaaaaaagcagtgtagttttcagctttgataatgccttacagtgttcttttataatggttcttgtaaagtgtgcgtctcagttacttaatatataaaaattggaataccccagattggaaacaaaaaatcaagcagctttgtagtaactataagttctgtagctttttggcaaggaaatacttcaacatcaacacatactgaaaatagacatataataactaaaacataaactccatggagagaggaagctggatgaaatccagctctttttctatgggcctcaatctatataatagctacctcactaggaagtagaagtagtatctaaaagttccttaacttgtctatttttaatgaggatgtcagagaagatgagaaaccttttgcttccaaagcatcttaaaagtcaagtattactccaaaagcatacatgttattgtacatatatttacattctggtctttggccagtttacatgctctagtaaatacaataagttctgccatccaggtttattttacctgaagtagagaactatattctaaagaagagcttaaattagtgataggatatcctgtttgataactactaccttctgatttaagtatggtccatcaacaaataatatttagaccaagttcttgatgggagtctcttctacacatcagtaaaataaagagagctccctaattgaggttagagaatgataagttttcccttgcttcctttaggggcaggagaatggcaggactgagagtgttttagtggtaaatagtaataggaaaggaagaaagtgacagaatctcttaagtagttaatcagatggctgggaaacataatgtgtgctcaatcagtagtaattctgtgctgggtgagaaactgtggggtcaagcaaggagctaaaaactagttcctcagaggcatgaatgagtttggttgcagcagctattgtcctaagatatacaagggcttaagctcttgtaataggaccaagtgtgaggctatagtaactggtgagtttgtgatgactcctttaaagttgagttaaaatctcagtgctcgtccagattgttcatgcacaagtagaccaaagggatttttgtagttagggatgcctaagaaaggaggctgctgaagaaccatcttcgaattttagaaggccttttcatatttgcattcccagaggagctctatagaacgtgagaaggtaagtgtttataagctctatagaacatgagctggatcacacatttttatctttattagtctgtttcaagtggcaagaatttggccaatcaccttaagaaggttgctgaattcaaatttatattacctatttcctacctgttactgaggacttagttcataattaagtgtgaaaatctaagaaaaaatttggcactcttctgcaatatcaagtttaacttagaaattctctcaaatgtcattcagcaaggggtctagaataagtttgatggtctttagtctatcaggagattgcatttttccctccatagatgggtctggtcctaaataatggacgatgttttggcaaaaattgtaatttatcttctaggactttatgtccttttccatttaaaatatgaggaagtagggggcaggttccaagatggccgaataggaacagctccagtctacatctcccaacatgagcaacacaaaagacgggtgatttctgcatttccaactgaggtactgggttcatctcactggggcttgtcagacagtgggtacaggacagtggatgcagcccaccgagtgtgagctcaagtggggcaaggcatcacctcacctgggaagcacaagaggtcagggaattccttttcctagccaagggaagctgtgactgatggcacctggaaaatcgggtcactcctaccgtaatactgcacgtttccaatggtcttagcaaacaacacaccaggagattacatcccatgcctggctctgagagtcccacgcccacggagcctcactcattgctagcacagcagtctgagatcaaactgcaaggtggcagtgaggctgggggaggggcgcccaccattgctgaggcttgagtaggtaagcaaagcagccagaaagctcaaactgggtggagcccaccgcagctcaaggaggcctgcctgcctgcctctgtagactccacctctggggggcagggcatagctgaacaaaaggcagcagaaaactctgcagacttaaatgtccctgtctgacagctttgaagagagtagtggttctcccagcacggagtttgagatctgagaacagtcagactgcctcctcaagtgggtccttgacccctgagtagcctaactgggaggcacccccaagtaggggcacactgacaccccacacggctgggtacccctctgagacgaagcttccagaggaacgatcaggcagcaacatttgctgttcagcaatatttgctgttctgcagcctccgctgctgatacccaggcaaacagggtccggagtggacctccagcaaactccaacagacccatagcttaggatcctgactgctagaaggaaaactaacaaagagaaaggacatccacaccaaaacctcacctgtaaatcaccatcatcaaagaccaaaggtagacgaaaccacaaagatggggaaaaaaacagcagaaaagctgaaaattctgaaaatcagagcacctctcccccaacaaaggaacgcagctcctcgccagcaatggaacaaagctggatggagaatgactttgacgagttgagagaagaaggcttcagacgatcaaacttctccgagctgaaggagcaagttcgaactcatcacaaagaagctaaaaccttgaaaaaagatgagacgaatggctaactagaataaccagtgtagagaagtccttaaatgacctgatggagctgaaaaccatggcacgagaactacgtgacaaatgcacaagcttcagtagccaattcgatcaactggaagaaagggtatcagtgattgaagatcaaatgaatgaaatgaagcaagaagagaagtttagagaaaaaagagtaaaaagaaatgaacaaagcctccaagaaatgtgggactctgtgaaaagacgaaatctacgtctgattggtgtacctgaaagtgacggggagaatggaaccaagttggaaaacactctgcaggatactatccggagaaattccccaacctatcaaggcaggccaacattcaacttcaggaaatacagagaacaccacaaagatactcctcgagaagagcaactccaagacacgtaattgtcagattcaccaaagttgaaatgaaggaaaaaatattaacggcagccagagagaaaggtcaggttacccacaaagggaagcccattagactaacagcggatctctcagcagaaactgtacaagccagaagacagtgggggccaatattcaacattcttaaagaaaagaattttcttttcctttttttttttattctacttcaagttttagggtatatgtgcacaatgtgcaggtttgttacatatgtatacatgtgccatgttggtgtgctgcacccattaactcttcatttaacattaggtgtatctcccaatgctatgctgcccccatacccccaccccacaacaggccccagtgtgtaatgttccccttcctgtgtccatttgttctcattgttcaattcccacctatgagtgagaacacgcagtgtttggttttttgtccttacaatagtttgctgagaatgatggtttccagcttcattcatgtccctacaaaggacatgaactcatcctttcttatggctgcatagtattccatggtgtatatgtgccacattttcttaatccagtctatcactgatggacatttgggttggttccaagtctttgctattgtgaatagtgctgcaatgaacatccatatgcatgtgtctttatagcagcatgatttataatcctttaggtatatacccagtaaagggatggctaggtcaaatggtatttctagttctagatccttgaggaatcgccacactgtcttccacaatggttgaactagtttacagtcccaccaacagtgcaaaagtgttcctatttctcaacatcctctccagcacctgttgtttcctgactttttaatgatcgccattctaactggtgtgagatggtatctcagtgtggttttgatttgcatttctctgatggccagtgatgatgagcatcttttcatgtgtctcttggctgcataaatgtcttcttttgagaagcatatgttcatatccttcacccacttgttgatagggttgtttttgtcttgtaaatttgtttgagttctttgtagattctggatattagccctttgtcagaagagtagattgcaaaaattatctcccattctgtaggttgcctttcactctgatggtagtttcttttgctgtgcagaagctctttaatgagatcccatttgtcaattttggcttttgttgccattgcttttggtgttttagacatgaagtccttgcccatgcctatgtcctgaatggtactgcctaggttttcttctagggtttttatggttttaggtctaacatgtaagtctttaatccatcttgaattagtttttgtataaggtgtaaggaagggatccagtttcagcattctacatatggctatccagttttccagcaccatttattaaatagggaatcctttccccatttcttgcttttgtcaggtttgtcaaagatcagatagtggtagatatgtgccattatttctgatggctctgttctattccattggtctatatctctgttttggtaccagtaccatgctattttgattattgtagccttgcattatagtttgaagtcatgtagcgtgatgcctccagctttgttcttttggcttaggattgttgtagcaatgcaggctcttctttggttccatatgaactttaaagtagttttttccaattctctgaagaaaatcattggtagcttgatggggatggtattgaatgtataaattaccttgggcagtatggccattgtcacgatattgattcttcctatccatgaacatggaatgttcttccatttgtttgtgtcctcttttatttcattgagcagtggcttgtaattctccttgaagaggtccttcacatcccttgtaagttggattcctaggtattttattctctttgaagcaattgtgaatggtagttcactcatgatttggctctctgtttgtctgttgttggtgtataagaatgcttgtgatttttgcacattgattttgtatccggagactttgctgaagttgcctatcagcttaaggagattttgggctgaaatgatggggttttgtagatatacaatcatgtcatctgcaaacagggacagtttgacttcctcttttcctaactgaataccctttatttccttctcctgcctgattgccctggccagaacttccaacactatgttgaataggagtggtgagagacggcatccctgtcttgtgccagttttcaaaggcaatgcttccagtgtttgcccattcagtatgatattgactgtgggtttgtcatagatagctcttattattttgagatatgtcccatcaatacctaatttattgagagtttttagcatgaagggctgttgaattttgtcaaaggccttttctgcatctattgagataatcaagtggtttttgtcattggttctgtttatatgctggactacgtttattgatttgggtatgttgaactagccttgcatctcagggatgaagcccactggatcatggtggataagctttttgatgtgctgctggattcggtttgccagtattttattgaggatttttgcatcgatgttcatcagggatattggtctataattctctttttttgttgtgtctctgccacgctttgttatcaggatgatgctggcctcataaaatgagttagggaggattccctctttttctattgattggtatagtttcagaaggaatggtaccagctcctccttgtacctctggtagaatttggctgtgaatccatctggacctggaattttttttgattggtaggctattaattattgcctcaagttcagaacctgttattggtctattcagggattcaatttcttcctggtttagtcttgggagggtgtatgtgtccaggaatttaaccatttcttctagattttctagtttatttgcattgaggtgtttatagtattctctgatggtagtttgtatttctgtggaattggtggtgatatcccctttatcaatttttattgcatctatttgattcttctctcatttcttctttattaatcttgctagtggtctatcaatcttgttcgtctttttaaaaaaccagctcctggattcattgattttttgtagggttttttgtgtctctatttccttcagttctgctctgatcttagttatttcttgccttctgctagcttttgaatgtgtttgctcttgcttctctagttctttcaattgtgatggtagggtgtcaattttagatctttcctgctttctcttatgggcatttagtgctataaatttccctctacacactgctttaaatgtgtcccagagattctggtatgctgtgtctttgttctcattggtttcaaagaacctctttatttctgccttcattttgttatgtattcagtagtcattcaggagcaggttgttcagtttccatgtagttgagcagttttgagtgagtttctcaatcctgagttctagtttgattgcactgtggtctgagagagtttgttataatttttgttcttttacatttgctgaggagtgctttacttccaactatgtggtcaattttggaataggtgtggtgtggtactgaaaagaatgtatattctgttgatttggggtggagagttttgtagatgtctattaggtccgcttggtgcagaactgagttcagttcctggatatctttgttaactttctgtctcattgatttgtctaatgttgacagtggggtgttaaagtctcccattattattctgtgggagtctaagtgtctttgtaggtctctaaggacttgctttatgaatctgggtcctcctctattgggtgcatatatatttaggatagttagctcttcttgttgaatggatccctttaccattatgtaatggccttctttgtctcttttgatctttgttggtttaaagtctgttttatcagagactaggattgcaacccctgcctttttttgttttccatttgcttggtagatcttcttccatccctttaatttgagcctatgtgtgtctctgcacgtgagatgggtctcctgaatacagcacactgatgggtcttgactctttatccaatttgccagtctgtgtcttttaattggagcattcagcccatttacatttaaggttaatatcgttatgtgtgaatttgatcctgtcattatgatgttagctagttattttgctcgtgagttgatgcagtttcttcctagcctcgatggtctttacaatttggcatgttttttctggggcctgtaccggttgttcctttccatgtttagcgcttccttcaggagctcttttagggcaggcctagtggtgacaaaatctctcagcatttcttgtctgtaaaggattgtatttctccttcacttatgaagcttaatttggctggatatgaaatactgggttgaaaattcttttctttaagaacgttgaatattggcccccattctcttctggcttgtagagtttctgccgagagatgagcttagtctgatgggcttccctttgtgggtaacccgacctttctctctggctgcccttaacattttttccttcatttcaaccttggtgaatctgacagttatgtgtcttggagttgctcttctccaggagtatcttcgtggcattctctgtatttcctgaatttgaatattggcctgccttgctagattggggaagttctcctggataatatcctgcagagtgttttccaacttggttccattctccccgccacttttaggtacacagtgagacatagatttggtcttttcacatagtcccatatttcttggaggctttgttcatttctttttattcttttttctctaaaattctcttctcactgcatttcattcacttcatcttccatcactgataccctttcttccagttgatcaaatcggctactgaagcttgtgcattcatcacgtagttctcgtgccgtggttttcaggccatcaggtcctttaaggagttctctgcattggttattctagttagccattcgtctaattttttttttcaaggtttttaacttctttgccatgggtttgaacttcctcctttagctcggattagtttgatcatctgaagccttcttctctcaactcatcaaagtcattctccatccagcttcattccattgctggggaggagctgcgttcctttggaggaggagaggtgctctaatttttagagtttccagtttttttgatctgttttttcaccatctttgtggttttgtctacctttggtctttgacgacggtgacgtacagatggggttttggtgtggatgtcctttctgtttgtcagttttccttctaacattcaggaccctcagctgcaggtctgttggagtttgctggaggtccactccagaccctgtttgcctgggtatcagcagcggaggctgcagaacagcagatattggtgaacagcaaatgttgctgcctgatcattcctctggaagttttgtctcagaggggtacctggccgtgtgaggtgtcagtctgcccctactgggggatgcttcccagttaggctactcgggggtcagggacccacttaaggaggcagtctgaccattctcagacctccagctccatgctgggagaatcactactcccttcaaagctgtcagacaaggacatttaagtctgcagagttttctgctgccttttgtttggctatgccctgcccccagaggtggagtctacagaggcaggcaggcaggcctccttgagctgcagtgggctccacccagttcaagcttccaggccgctttgtttacctactcaagcctctgcaatggcgggcgcccctcccccagccttgctgccgcattgcagtttgatctcagactgctgtgctagcaatgagtaaggctccgtgggcataggaacctccaagccaggtgtgggatataatctcctggtgtgctgtttgctcagaccattagaaaagtgcagtattagggtgggagtgacccgattttccaggtgctatctgtcacccccttctttgactaggagagggagttccctgaccccttgagcttcccaggtgatgcgatgcctctccctgcttcagctcgtgctcgaagcactgcacccactgtcctgcacccacggtccaacactccccagtgagatgaacccagtacctcagttggaaatgcagaaatcacccatcttctgcatcactcacactgggagctgtagactggagctgttcctatttggccatcttggctccactgcaagaaaataattttcaacccagaatctcatatccagccaaactaagcttcataagtgaaggagaaatacaatcctttacagacaagcaaatgctgagagattttgtcaccaccaggcctgccctaaaagagctcctgaaggaagtgctaaacatggaaaggaacaaccagtaccagccactgcaaaaacatgccaaattgtaaagactatcgagtctaggaagaaactgcatcaactcacgagcaaaataactagctaacatcataatgacaggatcaaattcacacataacgatattaaccttaaatgtaaatgggctgaatgctccaattaaaagacacagactggcaaattggataaagagtcaagacccatcagtgtgctgtattcaggagacccatctcacgtgcagagacacacataggctcaaattaaagggatggaagaagatctaccaagcaaatggaaaacaaaaaaaggcaggggttgcaatcctagtctctgataaaacagactttaaaccaacaaagatcaaaagagacaaagaaggccattacataatggtaaagggatccattcaacaagaagagctaactatcctaaatatatatgcacccaatagaggaggacccagattcataaagcaagtccttagagacctacaaagacacttagactcccacagaataataatgggagactttaacaccccactgtcaacattagacaaatcaatgagacagaaagttaacaaggatatccaggaattgaattcagctctgcaccaagcagacctaatagacatctacaaaactctccaccccaaatcaacagaatatacattcttctcagcaccacatcacacttattccaaaattgaccacatagttggaagtaaagcactcctcagcaaatgtaaaagaacaaaaattataacaaactctctcagaccacagtgcaatcaaactagaactcaggattaagaaattcactcaaaactgctcaactacatggaaactgaacaacctactcctgaatgactactgggtacataacaaaatgaaggcagaaataaagatgttctttgaaaccaatgagaacaaagacacaacataccagaatctctgggacacatttaaagcagtgtgtagagggaaatttatagcactaaatgcccataagagaaagcaggaaagatctaaaattgacaccctaccatcacaattgaaagaactagagaagcaagagcaaacacattcaaaagctagcagaaggcaagaaataactaagatcagagcagaactgaaggaaatagagacacaaaaaaccctacaaaaaatcaatgaatccaggagctggttttttaaaaagacgaacaagattgatagaccactagcaagactaataaagaagaaatgagagaagaatcaaatagacgcaataagaaatgataaaggggatatcaccaccaatcccacagaaatacaaactaccatcagagaatactataaacacctctatgcaaatatactagaaaatctagaagaaatggataaattcctggacacatacaccctcccaagactaaaccaggaagaaattgaatccctgaatagaccaatcataggctgtgaacttgaggcaataattaatagcctaccaatcaagaaaagtccaggaccagacagattcatgccaaattctacgagaggtacaaggaggagctggtaccattccttctgaaactattccaatcaatagaaaaagagggaatcctccctaactcattttatgaggccagcatcatcctgataccaaagtctagcagaaacacaacaaaaaaagagaattttagaccaatatccctgatgaacatcgatgcaaaaatccttaataaaaaactggcaaactgaatccagcagcacatcaaaaagcttatccaccatgatccagtgggcttcatccctgtcatgcaaggctggttcaacatacacaaaggtaatccagcatataaacagaaccaaagtcaaaaaccacatgattatctcaatagacgcagaaaaggcctttaacaaaattcaacagcccttcatgctaaaaactctcaataaattaggtattgatgggacatatctcaaaataataagagctatttacgacaaacccacagccaatatcatactgaatgggcaaaaactggaagcattgcctttgaaaactggcacaagacagggatgccgtctctcaccactcctattcaacatagtgttggaagttctggccagggcaatcaggcaggtgaaggaaattaagggtattcagttaggaaaagaggaagtcaaactgtccctgtttgcagatgacatgattgtatatctacaaaaccccatcatctcagcccaaaatctccttaagctgataggcaacttcagcaaagtctccggatacaaaatcaatgtgcaaaaatcacgaggattcttatacaccaataacagacaaacagaaagccaaatcataagtgaactcccattcacaattgcttcaaagagaataaaatacctaggaatccaacttacaagggatgtgaaagacctcttcaaggagaactacgaaccactgctcaatgaaataaaagaggacacaaacaaatggaagaacattccatgttcatggataggaagaatcaatatcgtgacaatggccatactgcccaaggtaatttatacattcaataccatccccatcaagctaccaatgattttcttcagagaattggaaaaaactactttaaagttcatatggaactaaaaaagagcccgcattgccacaacaatcctaagccaaaataagaaagctggaggcatcacgctacctgacttcaaactataatacaaggctacagtaaccaaagcagcatgctgctggtaccaaaacagagatatagaccaatggaacagaacagaaccctcagaaataataccacacatctacaaccatctgatctttgacaaacctgacaaaaacaagaaatggagaaaggattccctatttaataaatggtgctgggaaaactggctagccatatgtagaaagctgggactggatgccttccttacatcttacacaaaaattaattcaagatggattaaagacttaaatgtaacacctaaaaccataaaaaccctagaagaaaacctaggcaataccattcaagacataggcatgggcaaggacttctgtctaaaacaccaaaagcaatggcaacaaaagccaaaattgacaaatgggatctcattaaactaaagagcttctgcacagcaaaagaaactaccatcagagtgaaaggcaacctacagaatgggagaaaatttttgcaatctactcatctgacaaagggctaatatccagaatctacaaagaactcaaagaagtttacaagacaaaaacaaccccatcaacaagtgggtgaaggatatgaacagacacttctcaaaagaagacatttatgcagccaagagacacatgaaaaaatgctcatcatcactggccatcagagaaatgcaaatcaaaacctcaatgagataccatctcacaccagttagaatggcaatcattaaaaagtcaggaaacaacaggtgctggagaggatgtggagaaataggaacatttttgcactgttggtgggactgtactgtaaactagttcaaccattgtggaagacagtgtggcgattcctcaaggatctagaactagaaataccatttgacccagccatccctttactgggtgtatacccaaaggattataaatcatgctgctataaagacacatgcatacggatgttcattgcagcaccattcacaatagcaaagacttggaaccaacccaaatgtccatcagtgatagactggattaagaaaatgtggcacatatacaccacggaatactggtgtaagaaaggatgagttcatgtcctttgtagggacatgaatgaagctggaaaccatcattctcagcaaactattgtaaggacaaaaaaccaaacactgcatgttctcactcataggtgggaattgaataatgagaacactggggcacaggacggggaacatcacacaccagggcctgtcatggggtgggggagggggggatagcattaggagatatacctaatgttaagtgatgagtaaatgggtgcagcacaccaacatggcacatgtatacatatgtaacaaacctgcacattgtgcacatgtaccctagaagttaaaatataataaaaaaaaaaaaaaaatatatatatatatatatatatatatgaggaagtaaatggtatacattgtacaggctttcttgttctctgagcaaagtagatcagctgcatattatatcagaatcataaggaaaatttaggtcttttaagtcttaattggggacctgggaaaaacagaaggtgatttcagtgaatacctggggcatcactattcaaatactttgtcatcctcctcaggggagggcaaaaatgtttttttatctttgactaaagacagactaaaaaaggcagaacaaatgtctactatagtgaagcaagtggcctaaggaagatatttacgttagatattaccagaaatggaggaattacaattctgttgatggttctgagatcttcaactaatcaacatctttatccatttggttggttgtttttggttttttgtttgttgttttgttttgttttgtttcactggatgaacagaatggttactaggcctactatggggtatgaaaaggcctttggctaaaaagccttcaactataggcttgtgtctttattttctctctctctctctcgctctctcttgcttcaagggatgttagggaagtttgggtaacagtttggcagaactttaataggtctgtccaattattttccttatgtcagtggcattttcattcacagagtgtcaagatctctgcatggggtatatacatcaacaataatgaagaaagcaaaggtatacccagagcaggcacaacttcattatgaacacagcagacctcaaagtcctaaagaagttgttcctctggtgttcttttaatattacaattccatttgcaaaataagtctctcattatatttacaacagtggtatcacagagcagaaaggaatgctttacaatcagggtcaaggttatagtcaaagcctaggagacagggaatctatacattatttgaaatacctaccacctgtgtggtatgtttactccaaggaagaagttgagtaaaggaggcagagtttaatatagaaagagtagtacatatatctaccagaatctggtgaggtttcaacatttatatttatagttaattcatcctgtatgtttaagactaaggcaaaatgttgggcactgttttcttccttagagagctcttgttgatctgaattgagaaatttttctttatcatggcttttcttttccaagatgaaaccatcttttttcccttgttccttctgtttacaatttctacaggtatctttgttaatagatagtctgttaggaagttagccacccagctgtttggtctgcagaggtgtaagtttatttggttcctctctcattttgttctagagccctttcaagacattctacctggtgttgtagttcaggtaaaaggcttactttccgttctaatttctgttttcttattaggtccccaatgaaagggctgctgttatgtcaacatcttctttaactaccagatgttgtcagatggtattttctagcctatcctaaaatcctctatagtttcatcttttctctgtttgcatgatttaattgcagtccaattaatttttattgcaaatgtttaagatatggcttttgggaaactttgtcctactttccagccctattttttgactctgagatttattagggaaagggggatcctacaggcccctttttggatcagtctcatttcttttgccaccaagaatttagtatctaagattccaaccaacatcagtacaagtggatataaatcagttaactctattgagtgcatacgaggtatatgcactcaaaacaattctaaattcttctatgaatagctgctgatcatgcctggattaagagaacttcataattatagttcttaattcagcttggctccaaggttttaattctactgtagctttcatctggctcatgggcaagatgatagatgtttagaggcaattgacattttgaggcctttaaacaagtctttaggaaaaggtagggcatctggacaaggtgagtaggtaagatgagtccatgggtgtgcagaagaggaaagatttgaaaaatagagaaaaaaagtagagctggacatagggaagtacctggaggacaaggaggaagacaatttactagggaaaataaatacagtatattgttacctaagtgtgtcaaattgttcacttgctttggccaaaaaaaaaaaaaaatctcttagtaaagcaatgttttctcagagttttgttttgaggcctctgaatactaattaaattttttaaatgctaccaattgggcctgagaaagcttaattccttttattttctaaagcatctctcaaatgaacagttttgttcaagttcaaacattctccaaagtggccactgaatgcccaaagcatctgtggcaaaattctactatttaaagagataagcacaaaagttcatattgttatgagaatatagatgagacatagaagtttcttccagcagttggggaggatttctatttaaacaacccaggagagctggcaacagtcagtcaaaagtgatgcttttgcacttcgtgtcccaggacccctacctgacagttggctgcctccaaaagcaagcagcacccccagcagtcataaaaccagagaaaagactctctctgaatcaaagccaagctctcaagacaaaacagtctagacagaagaagaaacttatccagttttattggtgacccaagcaaagtttgtctgtatagatgctagtccagtgagaaccacaaactcacccatctacaaggctggctcaaacaacgggcctacaagtcctatgtaaaaacacaaaaaaagagaagaaagggataaaaaggagtggccttattccaccaagaattccaaacaaatgggaaccaataatgaaacccaggtgcagccgggcatggtggcccacgcctgtaatcccaacactttgggaggctgagcaggcggatcacctgaagtcaggagttcaaggtcagcctggccaacatggcaaaaccctgtctctaccaaaaatacaaaaattagccgggtgtggtggtgggcacctgtaatcccaactacacaagaggctgaggcagaagaattgcttgaacccgggaggccgaggttgcagtgagcggagatcgcgccactgtactccagcctgggcaacaagagcgagaacctgcctcaaaaataaaataaaataaaatataaaataaaataaaacccaggtgctaaactgagaatagatagccagggaacccaacacaagagcatggagctcagactcagtgataaccttccgcataagcattgactcgacaaactgtgaacagtaaggcacaagggctttctgtggctgctgcacctggctgaaggctgggatccacggtgctgggcagtatagaccatatgtcagtggaagctccagaaaatctctagaaataaacaaagaccacccaaattagaacaagcagaggctacttattcagagcttatgacagcaagggagtcagccaccaccacttgaatttggtagaggctcaagtcaggtaaggaagtggaaatctttatagtgaaaaaaaagacacaaagcttcaagtgtgctttgataggaggttgttgggattgggaagctggaggcaggataaatagtggaaggacatcttatgtcattggtttggggagtatatttggctctccctagttggtcctgagttagcagtggaagaaaaaaacacggaagttggcagtcactgaccaagtcctgggtggattgctccagagttagtagtttgctccagagttagtagtttgacttcccaggttgcttgctatagagtttgtaggtcagaaatctattgtcacatttggtcaggtcattgtttatattttcagtttctcaatcttttaattttctagttcattttccactaattgtccctgctctttgtacatataattacaaacatttggcacaacttaaatgttgaacattagggtattattgatggctatttaatttctatcatctaaactcctaatgttggccatttagaattcctcggaatcagttccaagtggagaggggaataaggatgcagcttctctggcctctcaaataggctggctccagattaagtaaattatagcccaagaaatactgactgggtcttcagcaacacaggccactggaaacgtagggaaaatagaaataagtgggaggagatacggaataacaataatagcattaactattatttttaagccattgagtcttcacaacaacacttttaaaggtgaatctttattatttctactttacagatgaggaaactgaaccagagaggttaagtaacttacccaagatgtacaactagtaagtgacagagtaacaagctcttgagcatgatgtttttagctaatgtaacaagggaaaccatgcctgaggacagacaaagcaagatcctgtcatgattaagacaaccagattgggagtccttcagacctgagttcaaatcccagctccagcacatattggcagtgtggcctttaacaagcccattaacctgtctgaactctgaattcctcatctgcaaaatggggataaaatatccagagccagatgaaatctatcatgtcttccaggcagttatttatgatgcctcaaaatatcattgaaaataaaatgagatgggagaaaaaaaaactatttctcagaatttttttcacagagaagaaatatctggctagaagaaatattttattcaattgctgagggagaagaacagtattaagtaacaataaacagtaatagttgccaaaccaccttctaaggacaggtgtgtctggttaacagtagggtttttgtttggcagagtgctttatgaattcctgggccagagcttaattgttctgtaaaatagaagaattgctgccatggccaacagggatcccctttatccactttgccacactacattcaggctctctataagtactagggattttaaaggatcaatttgaaaaggtacaaattattggactgccacaatacccacgtgccttggtctggcccagctcaggcttaactcatagaaacattgtaaagatgaagtgatattaggtaaaactatgcaagtgccaatacttaactgtttttaattccccaaaaacagtaattgcatgtggctcaacccaaacgtaaagtattgaggctactgtaattcaggacctgaaccagggtaattcttcgccaagggtaattcaattgccaagaagaaggtggctaatttcaacagagagcatttaaggttcaatctaacagatgggtaattctcaaattctggtgaacatcgacatcatggcttggaacttcagtccatttgaagccgaatgtctatcctgaggtgtctggcacaggacacagcacccagaacagggttctagtaagagtgaagctagattgtctgagtttcccaaccagcatactggggttcggggctgtatctgcatttcatgaagaaacagaagtgcaaaagacactgaggcagaagtccaaaggaaaggaaggaatgaaaaaggaatgcttgcattcccccttctgttctcactccccaaatgtgtccaaagtgcaatatttaaggcatgtatttcaagaaaaagagctatgtgtacagagaagtttgagaaacgtagcatactttgtcccaccctcacctcactacctgagagggatgtacaatacactttcatccaagaaccttcatttgacaaacatttgttcaggctaatatatacacagtaaaggccctaaaaagtcttacaataaagagcatgtttaattgtttaattttattgaacctagaatttcacaaatatattgataacagtaacttttttcttcataaaactaacattctgtggaacccaagttttcaaaagatactttagggtatgcttccctgggttatatatatgtatatatatttttttttttttggggggggggagttttcaaaagatactttaggatatgcttccctggggatttttgtttgtttgtttgtttgtttgttgggtttttttttttttttttttttgagacagggtcttgctctgccacccaggctagagtgcagtggcacaatcctaattcactgtagcctcaacctcctgggctcaagcaatcctcccaccttagcctcccaagtagctaggactacagatgcataccaccatgcccagctaatttttttttctagatggggtctcgctctgttggctggtcttggactcctgtcttcaagtgatcttcctgctttgaccttcgaaagtgctgggattacaaacatcagcctctgcacctggcctatacttattggctattctgtgcacatagttcagccttgcatcctctgtacttgcataatggctggcatagagttgagtttaacaaaggtcttttgaactgaatctgcaaaattaagggtatcaactagatcacttttcacatttcttttagctttcaacatctatggctctgtaatacatagatgtacctaagattatactagaaatgcttatcactggcatcaaggagacaaggattagtaaagatactctggtttctctccagtttaaatacatcttttgcctttttttaaaggattaaaatggacctctgagtaaaataatgaaagtcagggagagctttctggaggagatgagttttaaagacatcagagtaagcattgacagagaggaggggatggagtggtgagcctggatacaaaaaagggaagacatgtattaagattgttgtgcttgtcatttttttaatggcaacaagtttctcaagatttcatctatcaagtggtggtggggtccatgtcccctccccttgatggccctgctaatagagtacattagaagtggtgctctgtgacctcagagcctagaccataaatggtcattcagcttcacatggctgtcttagaatccttgctctcctaatacttctccttgggatggttgcccttaaatccagccaccaggttgtgagaaactccagctacatgtagagaagcgacacattgttgctccaagcagcagtcccgggtgagcccagcctatgagttatcccagcccagatgtcagagaagttggtgaaggagacatcttcagccccattgttctagtcctagcatttgagctatttcagctatagcagctgttcaagtttcattagctgaggcatcagacattgtggaacttggagttaccattcctatggtgctctgtctgaattactgacccacagaattcacagcagaacccacagtgatggccctatgctattaaatttggaggtagtgtgtcctacaacaatagataactaggatatttatgatggctgcaagttcaaaactccaaccaaactggcataagtaaaaagaggaatcttgtttcatgagtctgtaaagagcaggggctaagttgatctcaagcacaacagtccgggaactcattttgttatcagaactctctgcctgttacctctacttctctccccacatcagtaggaaagaaagcctgtctctcccaggagtcagtattcatttaaactttcagaggaagacattggcccagttggatcttgtgcacattcctggattaatgacttcttagaggactggaagtctacgaatggcctaagccagtggccaattcccctagccaacagcaagatatatggtaagagtgcaagagaaatttaccccaaaagaaacagctattctggagagacaaagcaatttgcaacaattacagtggttaaaatcttatttcagtggtaatttctgaagcagagtagatccatttgtccataggtaagatagaatatgacagacgaaggccctccccaactgaagatgagcaaaaagccctaaactctctgagacttggaaaagagtgctttcgaggagtgctaaaacctgccagattttttaaataaacatgtagtacatggtttcaccctggccatttcactgaacctcaccaccaatctaggaggcaggtaatgtaaattccctgttaagggtctaaaaacagctcacttagttacttgcccaaggtcatgtgcttctagggattagaagcaacatacaaagcctggtgttcagtctccaaatccaggaccccacattcaacttacatgaagacaactaactgaaaatgatgaaaaggagtcatttaccagaactaaggaaaaaaaaacaactttgtatacctaaaatccaaacacaaggatcctgaagtgctagttgttcagatataaatgaagcaatagtgggtgaggtcttcagacagagacattaaccacagcttgagagacctgttttctccattgtctaagtgcccttggacctcagacaaaccccttatttcttggaaacatgtattcctctgagaataaaggaaggcgtgtggtccagtaaatgcaattagcagtcttgctgcgtgtttccttgtctgttatctacccgaatacagccatcaaaaagctcatcttttcaaaacatgctcttccaaatgaccagagtcgccagtagattttaaataggtctgacatgtctagctagggagtcttccggatataagaaaatatttattgagcatctcctgtgaggaagacactactctaggcacagagggatatgagagagacagagacagaaagacagacagagagagagagagatattatataaggtacaggagagactccagcactgcatgactctgagaaaattatataacctcacctataatgtaggattaataatatgatgatagtacacaagtttgtatctccagcccagccactcttgtaactataggcctttgatccaaatgtctactcaaggctggatgtagtggctcacacctgtaatcctagcactttgggacgccaaggccggcagatcacctgaggtcaggagttcaagactagtctggccaacatggtgaaacctcgtctccactaaaaatacaaaaattagcagggcgtggtggcgtctgcctgtaatctcagctactcgggaggttgaggcacgagaatcacttgaacctgaggcagaggttgcagtgagccaagatcaggtctttgcactccagcccgggcaacagagtaaaactctgtctcaaaaattttaaaaataaataaataaataaaatctactcaaaatttgctctcagatgtttcatgggagctcccacatcaacataatcaaaagctgaactcatgactgtctctctcagttctgtaccttctctggtgtttctttgtaaaaagttcacagcaattccatcccagtagttccatcaaactagggctcttaaacattaatatggaagacacaacaaatacaccactttctcactcccatgaactccaaaccattggtggttcattaaccaccaatggcagggtggcggggggcaagttcgtatctgtagtgctccttgcacctgaccacttgaccttccagcagacaggtgcactggatctccatgaccgtgtctagaaccctgcagcattcactgcaatggtcaggtcaaatggaagacctgcttgagcaataatactctataaaaacaactgcagcagagaacaggaccatacaggtcatgactcagaacttcttattttttctctggagggcaacagtaatcgagactgaccccttgagataagcaaattccttagaatcctttactcagtcacacaggtgactccgagtagaaaataaagtcctcattgtaataaatgagactggaattcagaaatatttaatttgtacctccataagggtagaactaatcatgttgtattcataaatagtacacttgaatacctcttttactagactgtaagctccttgagaccaggcacaatgtctatctaaaccatgtctgttgtcctcacagagtctaactaacactgttagttgagaagatgtatattgaatcactgcagacactaagcttcctgtggatagatatgaattttgcttttatttcacttcccttataaaatcaggagatacttactgaattaagggtcttcagtttcagtccatggttttcagtagatttcaatttatgatttttattaaatagcaaattagagttgatgttggtggatacttcaagcttgtagtgaatgagtgtaggggttatttgccttttgacaaccattttgtgagtaaagagtttaaatcttaaaatgtaatgtggcattgtggtccatgcaggttgggagactgcacccattcttagggtgaacacaccagcattaatatgagaggagagaggggacctgtgggctgaactgcatggaaaccttgcctttcccggtggcactgcagtctcataatatgctgcatatgtgtgagaggatcaaagccacaacaagagaaatggtggctgcagaggcagaatttggggttaaagtgggataaagggtgtatcttgcattgtactggaatcaatttggtcttgctctccccttgtttccagtacttgggcacttgttttgtatttatttgacttttcatagctatcccacaggctcacatacgacacagaagtataggcatggtaggtctgtgggttcactttttttaagtaaaattcaaatgaatgggacatcagtgttagaggaaaatcataaaaggcatgactgcccaagatatttactctctccaaggatagtacaatcctactcagaacagttttcaagggctggaaagtgttacgaggtgaaaacaaaaccctattagcagggacctttgtccgtatcttctgtccagactactggggtttctttaaggtactgtacctatctgtacatcataaatgaggcattagctaaacggatggtgtgaatggcatcttccactcacaacttcattgttcaaccacttcttattctctgtggtgcacatctcagactgttctgagctacagtgttctagctaatggcttaacttttcattttgcactcttctctctcctcccaattctacttacactggcattttgcaactgagaaccctagctactcagaatgtgagtagagtagccctgtttctccccactggccaccttgtttatgattgccctgggtaaccagtctcctctccccaggcctggacctctttgctaccattctggagaggacccctaccaaatcctttggtacatgcaaggccgggacgcatcattgagcccttgaaactgcattctcataacatatcaaaatgtttaggggcaggagaaatgaatggaaaataaattaaaatcaaagaaatgtctggaaaaggctataaaaatgattcaatacacaagaagagttaaaaacctatctaacattcttctaaaattactaataccagaaaacagatatgcatatccatacccgccatctttgctgaatttttatgttgaccaatatactttcaattaaataacttgtggtctctctcattctccagaaagcataaagcatttccttctctgaataaaagaataaaaggtgaagtgaagacctgagtgaaaaattatctctagaagcaaagtacagcaatccccaaagtactgtaattttttttttgtttgcttcattagagttctgtgtaacctattctacaaatcagtcaaggaagggagtgaaagcctgaatagatgaaagggaagcggggatgtgagaggaagttctgctgggaaaatcacccatctctggaattaccatggattcttcttcctaaatgggaaaacacatacatgagtccaatgccattcacaaatagcaactgagactctgctgtatatcagacactccatatgagaagccaaacaaaattcaccccctgatcttgaggagctgatggttgaataggtggaaatagagctaataattttaatacaatgtggtaagcaccagatgctagaagcccactgcatggtcacataacccaacccaaatactcaaaggcttcccaaaggacacatctgaaccaagccttgaaggctgagtaagaattattgggattggcctgaaaccacccaaaagattttcattagttcctcattatcttatagtaacccagtccagtgcatgcaatggagactaagacacctttgtaatgagttcacaatgttgccatagagaagacttctacatacacacagaacaattacaaggaccaccacaagattataaacccaggctagacagtgtggttctgacacattcaagtaggtgtttctagtgctcagaatgtagttagtgctcagtacatatttgttgcattaattggcatcttgctctgaaggatatttaagccaattctaaagcattaatttccagagaagcaactaaagaagatactttaatacaccaatgcaagaaaaaaagactttgtccctgggatgtaccacatatggagtcacatttcagaggccaaacaaaacagttcatttccaggggtatgatgtagtttaatcaagaactgtattcttggctactatgaacttcatctcaggaaatctttttcaaatgcctactgtgtgccaaacatttgcttcatctcttggtaatcttcataaagattaataaaccaatatctgacctcaggacttcaatttctaggggagaagacagtacatccacccctcaggctcagctcatttcataagcaaatgtgcagtgttaagggtccacatgagcaggatgggtttcattgtaattttggtggatgtatgaagtcttcatggaaatgagggcatttgagcttggccttgaattatgactaagtcttcagcatgaagagagagggacaacctaggtgaagggaacaaaatgagaaatcagacagagacaagacaatattgttcacatctgggaatcgctgagaagttcagtgctgcaaactcaagagtgagggtgtattagtccattttcatgctgctgataaagacatacctgaaactgggaagaaaaagaggtttcactggatttacagttccacatggctgtggaggtctcagaatcatggtggaaggagaaaggcacttcttacatggtggcagcatgagaaaatgaggaagatgcaaaagcggaaaccccgataaaaccatcagatctcctgagacttattcactaccataagaacagtatgggggaaactgcccccatgattcaaattatctcccacagggtccctcccacaacacctaggaattatgggagtgcaattcaagatgagatttgggtgggaacacagagccaaactacatcagagggggaactcagaggtagagctggactaggaaggtacttatccagaggcaggtcatgtagcaggtactgttgggccacacctggatgccctcagaaagtgcccttttgctacaagccagcccaacttccaactcttcaaccaagggcattatctgaatgctggagcccactcagcctgcatgctgggcaggcagagtactaaggacttctttctcctttccactttccccaagcaatgatgaatggtgaataaacatacctgagggaaacctgaggcatatatttcccggcaggattagcctccagctgcccacatgttcatttgctttataatgatcctctctcagcttctttctctacctggtatcccttctccactccctttcttatgttttctaggttcactccagaaagctatcatttgcaggtgacttagaatcttagggtctgcttctgtggggaagccaaactaagacatcaggaagttatcattaatgatgaagtaagtgattatcaggaaatgcagccaaaggtcagttttgatgatcaagataatgctataaaggggaaacagaagagagatgccagcaggtagggaagtgagagaaggcagcaaatgtgagctaggaaggcagctgggggagcacagcaggacaagagcctcagaacaagagctgtgaagatgacagcttgatgtgcccattactcaattcaagggcaagcctaatggactgatggcttcttaatcattttgatttttagacccctttgagaaaatgatgaaagctttggactttctatccagaaaaataaaaagtgtatacaaacaattttgcttggaacttcaagggattcccaaacctcagattaagaacccctgattaaaggcttgatttgaggctggactctgggggccttgattgcctgcagagtgctttagcatttattccataggcaaggcagagccagcaaaggttttcactatcagagaattccaaagtggttatagttttccattctaaatggaacccaagaaatctggatgtttttaacagattgaaagagagattggaaaaaaaagtgcatagataattgagctccttgttggccaaaaacatttgcaaccagatgcactatatggcttcaaagactgctgactgcagaatccagatgcacctcaacaaatgccatgggagtcccttccgcagccaaatgttttggcctcggaaattcctggagcagaatggatgttgaatggagctggaaacaaactcagggcaaacacaactgtttatatgaccacatctaagagatttggagtgaaaatccccctgttacagagtggacagacagaggctgagaacaaaataatccacttgggggataaatagagatggtgcaggaaagcagagaaaatatggagaaggacatatccgaaacataattctagaaaatacaagctgatttgagaacaaaagagaaatacatagagacataaaaaaatgatggtaactagacttaaaagacctaaaaaactaatagagaagaagaaaagccaaattgttttttttcttttttcttacaaataaatttaaagaatagctctctttttttagtatctaccatatgtggaaatgataacaatacataaccctataagtaaggtattacctctatgttacaggtgaacaaactgagacccaaaagaaacttgtataaggccaccaaatgagtaatggtagaactagaatttgaacccagtgctgtgtgacttagaatcacacatactagctcctgttgcccttgtcccagaacttgtagttagacaccaaacacaactgaaagtaagacaaattacatgacctaggcaccaaaacaaaaaggaagaattgtccatgcctagacttttaaggactaagcaatggggaggcagagaggagactgatcttgctggtcactgtgatcatctacatgatgatctctcaactatcagtttccaagtcatcttgcctggcatattcccactgccagtcagggccgacctgtggggaatgggaagccctggtgtgccagaggcaggaggacctcagattgtgtcatccagatagatgtcctcgagtttctggtgtgacctatggtatggcagaaagagtatgaaagccaggtcatgaaaaccatccactacctcaacaacctactgaacctcttggagcttcagcttcagcttcttcactggtaaaaaccaaacctatggtacaatcatcatactaaatagtgatgcatgcattgtgtctagcatagtgtctgctacacacaagctctcaaaaactcaagattttgcatcccaacatcctttcttcaccctccttttttttttttttttttttttgagacggagtctcgctctgtcacccaggctggagtgcagtggcgcgatatcggctcactgcaaccttcatctcccaggttcaagtgattctcctgcctcagcctcccaagtagctgggattacaggcgcctgccaccgtgcctggctaatttttgtatttttagtagagatggggtttcactatgttggccaggctggtctcaaactcttgacctcatgatccacttgcctcggtctcccaaagtgctgggattacaggtgcgagccaccgcgcctggcctcttaaccctccttttctatttgagtcacttatttttatgttctctacaaactcataccaagacctgttagcaccctggttatagcttcttccctcatctcacttcaatatacatatatttaatatctactgtaatagcaaaacaaatttgcctagaattatgtaacttacaaaactcttccacttctgccacagcatctctctttaccatgcatctggaactgagcaaacaggaattattacccttttgttacctatgtctaaaaaaggcttagagagtgtatgttatgtgccccagttgcatagcaagttaagagttgggatggcttaaaggaacagagtcaagaaatatataggtgccttggacaagttacttgcctctttgagactcatttccttgtcttttttttttttttaaggcagttcaggatagccatgtccaagtccccttctgctgtgatcttcaaggattctgcttcaactctacatgagaattatccagcagaaacttttactggtctactgtaaatactacagatcaagcatagcaccccctcatgcttttattttaacctcaggatgaaatcaaatacaagaatgttgcattttcgtgtttagtgagtttccccggcagatctttcactcattcagtcaagaagtgcttgattagtaactactgtgtgtcaaatataataatagatgctgaggatacaactttaaacaagaaaaaatttctgctttccattagctcatagtcctgggtggagacagagaagaaaatagagagttacagggtatcagtgatcaagctgtcagttgcaaataatgggagtacaaactcttaattgaaaacatgatttgacatctatgtagcttttgtgatcttatataaatccaagataagactccttcaagaaaattttatgcaatggttcaatgatgttataaaaacttagtttctttacattcccagcatattggtattctagtatactagcacttctgctagacagaatatggctgccttagtgctagaacacacaggtagagcaacagaggaggaagaggaagtagaggcaacaatggcatcttcctgtacacctctttatcggtaaagcaacttttcccaaaagccctcaggagacgtctgctcttagcctattggccataactatgttacatgcccatccctaaaccaatgactggaaagaggaatgatgctgtcatgaacagatcgtcatgacttactcctagagctgggatggggtcacttctcctgagtcacatggggaaaaggtagacagatgaataaactcagcctctaccagcaaggcgaggaggggaagggctgttggatgggcaatagtttctggcctacagcacagaattcaccaatttaaggaatataacagaagtaagcccaagatacataggacaggcttctaaggcagcatgtgtgagctgtgctggaaatagaaatacatagtttgtgaaagttggactttcagatggaattaaaggcaaaaccagaaatgcgactgctttggggtgatgtagtgatatttacagactctcaagtgcctctggcaatcagctgactctagtgggatattgctagccccttgcagcagtgtccaaaccagggctgagagccaggggagacaggccaccctagggcagtttggacccctgaaggagctagcaaaggtcaactctaatcatgactcaagatttaacgtgctgtgattcaaggggtgtggcttctgcagtcagacagccttgagtttaaatttaagctctgctatttactgggaaaagcacagaaactctttgggtctcaatttccttatctgtaaaatggggatgcctacttggctggtcgagacttaaaataatgtatgcaaagcaataacaaagtgcctggcaagcaatagtaagtggtatatattattaatactagaaaaaaatacaagcagaaatggatccgagatgaacagaatgaggagaatgtacacaccctgaaaaggtttgttttgagccagaaattccaagcccaaaatgaaaatcaagtactgttttcatagttctttataatgtgtaaaattccattatcaccaattgtctcattggatcttcaaaaccaaggtattattaggactccctcattttacagatcaaaagagattcagctgagattccagccagatcacacacaagtagaggacagagctgatattcctgtctctgttgtcagctctccctgccacagcacactgcttctgtccatgcccaggcactgcacaggtcagtcaggatcacagcagaaggtcagcagcgaaggggcagccaggcagcatcaggggtgctggcagcatctgctcttggttctagaaatcccagggttcacaaagaaccattcatttatctactaagcgaagtttgaatgcccacaaattggttctaggcactggggatgccacgaccaacaagatagatttagtccctatccttaaagagcttcagtctagaggaaaaggctaccaagtaattaaacaatttcaataaagtgcaaaccatgagagaacagaatagggggccaatcgtagcatgattgtctttgaagacctcccaaaggagatgacaagtcttgaaggacagaagaatatagccagggagaggagtattcgcagcagaaggaagagcaaccagagtaagttttaaattggaaattgagataaacaacaaatgctttttcacataagtatatcccgaatactgcatagcatgtgtacaatcgaccaaaattcatttgttgattattgaaaattcagatttaactgtgcgactctaagccagaggcaagagaaaatatttacattcagtaaattaatagtagtttctcagtgctacaattttggagacaaaagaaagcagctaaacatcatgacagaaaaaagtgggaattcattttctcagggaattcaggcttcaagagagacttggctgcagattaaaaagctagaaacagtggaactagaagaccaacctgttaacaaatcactatatctaagtctctctctaaaggtctcctgtccagagaaacatttctcgaactttatctcacatcagaatatccgggcgggggtgggggggttgttaaaccacaggttgctgggcctaacacccggagctttagattcagtatatctggggtggcacttgataatttgaatcttaacacatttctggagtggctaatgctaacggggccatactttgaaaaacactggcccagagaatgaatcccagagtttatatcaggctctttccagtgttggtatgcatgagaatcatgtgggtaatcagctaaatatgaaatccctgcctcttccctatgatggaggttcagatgcatacagatgactctgatgtaggagatacacactgctctgctggagaaaaagtgattgctcaagtctatcaagctcttttttacttaattatgtatatttatttacatataaattatttgcctatactattgtactaatacattattttttcttgatacatgatatttgtacaaatttgtgggatactttgttacatgcacagaatgcatactggtcaagtcagggtatttagagtatctattgcctggagtattgatcatttctatgtattgggaatatttcaggtcctctcttctagctatttggaaatatgcatacatagttgttaattatagtcaccttactctgctatagaacattagaatttactccttctaactgtatatttgtacccattaaccaacctctcttcatgtctccctcaccaacccacacatcattccaagcttctagtattatatctatcattctactctctaccttcataaatcaacttttttagctcctacatatgagtaagaacatgcaatatttatctttctgtgcctggcttatttcaactaacataatgaccttctgttccatccttgttgctacaaatgacataaattcattttttatggccaaataatattccattttgtatatataccacattttctttatccatttgtctgttgatggacagttggttgattctgtacctcttctgttgtgagtagtactacaataaacatggggatgcaggtatcgatttgataaactgatttacttttctttgtataaatacgcagtagtgagattgctaggttgtgtggtagttctgtttttagtttgttgcaaattttccatactgttttccataatggttgtactaattttcaccatgtcctccccagcctttgttattttttagctttttagtaatagccattctaactgggataagatgatatctcattatggttttgacttgcatttccctgatgattagtgatattgagcaagtattcaaatatctgttggccaattgtatatcttttgagaaatgtccatttatatctttgcccatgtctttttaatgggattatttggtttttattattattattattatactttaagttctagggtacatgtgcacaatgtgcaggtttgttacatatgtatccatgtgccatgttggtgtgctgcatccattaactcgtcatttacattagatatatctcctaatgctatccctccccctgccccccaccccacgacaggccctggtgtgtgatgttccccttcctgtgtccaagtgttctcaatgtttaattcccacctatgagtgagaacatgcagcgtttggttttttgtccttgcgataatttgctgagaatgatggcttccagcttcatccatgtccctacaaaggacatgaactcatcattttttatcgctgcatagtattccatggtgtatatgtgccacattttcttaatccagttctatcattgatggacacttgggttggttccaagtcttggctattgtgaacagtgccgcaataaacatacgtgtgcatgtgtctttatagcagcatgatttataatccattgggtatatacccagtaaagggatggctgggtcaaatggtatttagttctagatccttgaagaattgccacactgtcttccacaatggttgaactaatttacactgtcaccaacagtgcaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtttgttggctgcataaatgtcttcttttgagaagtgtctgttcatatccttcacccactttttgatggggttgtttgacttttttcttgtaaacttctttgagttctttgtagattctggatattagccctttgtcagatgagtagattgcaaaaattttctcccattctataggttgcctgttcactctgatggtagtttttatgctgtgcagaagctctttagtttaatgagatcccatttgtcaattttggcttttgttgccattgctttcagtgttttagacatgaagtcctggcccatgcctatgtcctgaatggtattgcctgggttttcttctagggtttttatggttttaggtctaacacttaagtctttgatccatcttgaattaatttttgtataaggtgtaaggaagggatccagtttcagctttctacctatgcctagccagttttcccagcatcatttattaaatagggaatcctttccccatttcttgtttttgtgaggtttgtcaaaaatcagatggttgtagatgtgtggtattatttctgagggctctgttctgttccattggtctgtaacagagatacagatcaatgttttggtaccagcaccatgctgttttggttagtgtagccttgtagtatagtttgaagtcaggtagcgtgatgcctccagctttgctcttttggcttaggattgacttggcattgtgggctattttttggttccatatgaattttgaagtagttttttcaattctctgaagaaagtcattggtagcttgatggggatggcaatgaatctataaattaccttgggcagtatggccattttcattacattgattcttcctatccatgagcatggaatattcttccatttgtttgtgtcctcttttattttgttgagtctacctctccctttagatcagcagtccccaacctttatggcatcagggaccaattctgtggaaggcaattttttcatggaccaagggtggggagggggcatggtttcagaatgaaatggtcccacctcagatcattaagcatgagttagattctcttaaggagtgtgcaacctagataccttgcatacacagttcacaataggatttgggcttctatgaaaatctaatgctgcagctgatctgacaggaggtagagctcagacagtaatgttcactcactgaccactcacctcctgccatgtggcccatttcctaacagaccatggaccggtaccggtccgcagcctgaaaggtggggacccctgctttaaatctaataatatttactttatgtatctgggtgctccgttgggtgcgtatatgtttagaattgtcatatgttcttaccgagtcaatccttttatcattatgtaatgaccttctttatctctttttactgtttttcacttaaagtctgttttatctgatagaagtatagctagctactcctgctcattttttgtttccatttgcatagaatatcttttcccatacctttactttcaatctatatttgtctttacaggtgaaatgactttcttgtaggcagcatatttttatccattcagccaggttttttttaatccattcagccagtctatatagtttaagtggaaagtttaatcaatttattttcaaagttattattgatatgcgagggcttattcctgtcattttattaattgatttctcattgtttggtataacctttgcttctttctctcttactgttcaccattgtggtgaacaattggtggttttctgtactggtaacatttgaattctttctctttttcatttgtgtgtttcttctaccaatgggttctacaatttcatctgttttcatcatgatagacatcactctttcccttccaggtttaggactccttaaacatttcttgtaggaccagcctactggtgatgaatttcctcagcttttgatgatctaggaaagactttatttctccttcatgaaggagacttgaaggataactttgctacatatagtgttctgggttgacaattttttctttcagcactttgaatgtgttatcccattctcttctgtcctataaggttcttgctgagaaattcactgttaatttgatgggggttctcttataagtgactaaatgcttttctcttgctctttttatagttctgtttttgacttttgacagtttgattataatgtctcatgaagaacttttgggtttctctgtatctatctatttgatgattctgagcttcctgtatgtgatatctaaatctcttgctagacttgggaagttgtcagctattattttgttaaataaattttctatccttttgttctatctctttggtaaatgttcatttatatcattaattgttttcctgatttccttttaattttttttagttctgttgtatctcactaagtttctttaatatcattattttgaattattttcctggcattttatacatttctttttccttgagatctcttgttagagaattgttttattcttttggaggtgtcacatttcctcacttttttatatttcttgtatccttgcattgatgtctgcacatctggtataatagttacttcttctaatttttggattcgcatttgtagaagaggactttttcctgaaaatatctatggtgttggttgagtagcatgcttcggctttcattctgggtatgtgcagtactgtagtctccatataacttcttcagctttaaatggtgtcagtcatgtctttggtttcctcagtggcttagggtgtggtttttagtgaaggccattgttatgttttgctggggacagggatcccaggtggacctgtccttaagcctcagtaatggtagcagcaggctgagaatgcctgttcttgggctccagggagcatacactaacaacagtgttagtggctccagaaagactgactgattcttgggcctccaggcagcttgcttaagtgtcaacagtggcagtgatgggccaggcaggtgctctgatcattgggatcctggaaagtaggtatggcataggcaatcatagtagtagtgggacaaccctctgcctcccaagtgccccatgttggtgttggcagtggctaccataggctggatgggccagtctccaggcccacaaatggcacatgatgggaggatgccagctgtagtgatagtgtcagactaggtaggcccatccttaggcctctgggagggatgctcaagtgccaatgatagtgggtgggacaggccaatctccaggtccccagatagcatgctcaggcactgagtggggttaggcagaaagccaggccaaatagacctgtcctcaggactgcgctgatgcatacaagtactggctgtgatgggcaagggtggggtgatcccagaccaccagcagagtgggacagcagcagctgcaccacagccctgctgctgaggaggactgagaagcctatcctcagggcacttataaatgcatccacggctgggaatgataggatcactaccaatggggtacacttcggtccagcagtggaagctagtagcagcagcagctgcaggcagggaatatcaatggggctccagggctgtggagatacaggggctgttgggctccatggcaggatgcagtatggtgggagctgggctttcaaaatagcatcgtgttatagctgcttaggacccaaaggttgtgtagcactcagtgtaagctccctctccaaagcaatgctatcacaaggttctaagcagttccttatgttagtttcagggcccataaggattgaggagctcttccatggttgtgattacaggagtcttcggtaggaatgtggactgctggggatctctagttacttttgccccacactggggagcctttccaagcttcctgccaatccttgtatagcaaactgcctcactttcctcttcttccttgccttaggtgttttctgtcacttctctgttgaattccagtgttctctcttagatgatctattcaaagtgtgattatctactcactgttttggttttttgtggaagagggaggtgccagatgcctctattcagccctcttgagcccctcactctaacacattatttcaaatgatgaaagtatttagctttttaaaaatatacataaaagttctattttcttcccacaccccaatggattgccttgcatccacagttttgagacctttggactggccaagtgctgttcaaagtatggttcacaaaccagcagcatcagcatcatgtgggatcttgttagaggtacaagttcatggcgctgccccagatataatgaatcacaatttctggggtttgggcaatgagtggtttaataagctcttcacataattctatggacaatgaactttgagaaccactgatggctaaatccacaggtggggcaaggtgaccttggctctaagacaaggactgatgtaataaaagcacaatcacaagataaagctgagccaagggtgactctgagatactggaattccccactgaaattaactgcttttaataaacaaaattgggccaacaatgatcacattattattcagaatagtgttaacctaatgtcattatgatgctgttttgttgacatgacatcatcaaggaaaattattgatttctacgagattcaagaaatttacctgactaggtgaaacaatggtctagttttcccctagttgagggtaaccccaggacacaggactttcagtactaacccaggaaagtctaggaaaatcagaatagctggtaatcttacctacattccattatgaaaatgtttgatgtctttaagaaatcaacttcttttctttgttcctgtcaactaataacctctacataaggtgggcatggataggacaaaagaaccctagacttgcagatctggttctggctgtcatttaacagcagtgtgatatgtagcaagtcaattaatctctgtgaacctctgattatctgcaaaatggggatgaaaactcctgcctcccacacctcataggctaattgtcaaggccaagagagttagtgttatgaaagctatgcattacagaatccactgggaatgtaagcaacagccacttgacatcatggtaagcatgcaggctttcaggcaggcagatcccagtcttgacctcagtagcagcatcactttgagcacattattttatctctctgacatgattcccatctgtaaaatggcgactcaaattacctttctcatcgactattgagaagattaaaagagacgcaggtcgcaaagtgcctggcatatttggagctccaaaggattagttcccttccccgtgattataagacactcaacgacttaatgatagttttttgcagttaatgccatgaatagaatcattatgtttgcttcctgaagtgaaaagccacaataacactcctccttgcccccaggacccctttgatgtggcagggggtgggaaaggatgttacttctgcttggcataaccaagtcagaaaggctacccagtttctgcccacagagaagtggagtgaagtcactgcctcagagaggcctgaggacgaaattcacagtgaccttggtatctaagaatgccaaatctctgacttccacacctatttagtcattccttcagtcaatcgtacataatgtaaataaattatttttaatcatccctaacaattgcaaaaaagaacgtatgagcccagcctgtcctagcaggtaaaaaggggcaggagagggggtgtttaggggaatgtctcttttacatgcagagattttgtaacgttttatttctaaaggatttctttcattcactagccatttactgagccagatatcctgtgttttgagcatctactttgtgccagacttggtgcaatagcttctgcttgccaagaggctcacagatgcaaataaacccagagtttcaacccagggtgaaaaatctcttgatagaggtaagtctgagggatagtggtggcaatgaaggtttagcatcccctcctcagggccagtgctggaagtgggcaacactctgtaaattaagagtgcacacaggcccatggctgaagacaattacctcctagtattcattgtctttgccttgacatgtgacctcttccaggaaccctgaaagtaaatcacggccagtgaaatctgagcatagctgatcatgtgtatgtaacaaccaagctctaccactgaggaaaaggcatgctcatcacctccccttcccactttctttgtagatggaatccaggcacggtagtgaagaatcttggaccatgtggttgacaacagcactgagaaattgcaggacaagaaaagaagcctggatccttctttcatgaattcaaacagagccgccataaacacaaggacatttatataacagagaactgaacctctatcttacatttacctcaaatatcttgggtttccattacatgcagcaatatctgagttcttttactcctgtctatagtacaagttatttaactggatgaaccctctgtatttctgcaaattaactgacaaatattacaaacagcagaaatctccaaatgctagctgttatggaatgatgaattataatcagaagcccagttgagctcctctatgagcccacaaatagtttgtgtgtcattcaggggttgtggcagcctgaaatctgcaaagtatctatcagggagggtagtggtagatgctccctggatctcagcttctgcttctcttctctcctcccagcaacagctgcttgagtccaaactccaaagctgtcttaagtaggagagttagagtaaccacctcctagttctcaatctcaatttccccgccccttttgttttttaaattttcacctacactgccacaggatcaattccctcttgctgatagtttaactagaattttttgtttaacagtttcattcctggttttctgcctctgatgtggttcctgagctcctgtttcaggtataaagtctagaccatgaacaccaggcagtgactctggtaattcatatttccatctccagctagcacaggacctagcatgatacaagcacacattaaatgttgttttttaagtgaatgaatggtatgatatataccaccattgccttctaaggagcctttcctgttttcctagcctctactccaaaaactaagaggactcttaagaaatcctgttgactggcctgcacctttctgggtatgcttctgcaagtgaactggatcctcaggcatggcatatctgattcccatccacctgttggaatatctcactttcttacatagtgcttcatttgcagtcttgcccaccttcccttctggacaagaaggtggctactgatttgcccaagctgggattccaaaacccaaggctagaaatgaaccaatggtcatgatcataaagtacagaggaaaggagaatcaaggtctctaacctgggcaaagataggccttgaaaaaagtatggccaaaattatcaagctcaagacaggggttagaaatcaaatatgagctcgggactatagactctgctccaagagagtaggcaggacaaagttaggggaaccagaaggcagaggctagaaaactgagaggcaagaaatcactaacagggcatctctaggaagtgcacggctgggaagaaagccatggagggctcacaaatcatacaggcctgactgcctgctcaaaccatgacttatggtcatattctctggtgatcctagttgtctgtcgtgaagaacgtttcttcctgtgttcattcaggtcctccaaaaaccataggccaatttggagttggaagtgtaagagatttattgaggacaatgcctgtatgagggaaaggagagggagaaacagtaggcagggcaagtctttatgttacaatgcagatctacttgtgaaagaagatagggaggcaggaggattgagtagaaaagtctcagactatggttcagctgaagaaagtttccaccagctcaaacaggagcttcattgcaaagattgccacagagagatcttaaggtgggcagaaatggcttctagtttcatccctgatacatggtaatttgcttcatgattcccacatgaactcagagataatctaggcagcattgctcaaaagaactttctatgatgatggaaatgttctatatctgtccaatgtggtagccagtaaccacatgtagctattgaccactggacatgtgactagtgtgactgaggaactgaatttttgttcatttaattacatttcaatagttgtaagtgtctaccatattagacagcacagacacagagttcaacttttttaactgaagacattgagcctaaatggagcaggtccaaatacatttaagaagttaaggttaaacctagaactcgaacccaatctttttaagtgcagccttctctaaataagccatttctgagttaggatagagaacatactactttgtttagaaacttggaccttcatttccaaggcacttcacatatttcaagggtcacagactctgatctttctccaagtaattcacagctaattccatgccaaaagatgtctctttatgatcaactcctggtccttcatccttgtgcttgcctatgtatttgtgcatggctcctgtgacctctgctgcttaggaagttttctgatctactttgtttccagacaccaatgttcctccactgtcatttagactgccaccgcctgctcccagcactggagccaagcatgccacacttgagagttgcaagcttctctgcccggccatgactgaagccttcgtgttaatccagctagatcccctgctgagcccagggtcatgaatcccctctcaggccttttcctcctccctgatctaatccatcacctgcagcccagatggggagaccacaaatctctaggaatgcattcctagcagaggacatgtgattactccaagactcaccattcattccaagacctggaatctggcagcctgggggagtacacacttcctttgggcccaagacgggagagtacttttcctgtagcatctgaaacagagccttcactggaaccaaaacatttcaaaacaaatgacaacaaaaaaggacttttacacctctcccccaatctttcccattcccttcaccctgaatcccccttctttttgaaagaattatcatcacatgtaaaattccaccagatattcttttcatgtgctatctctcctcctttacttcggattgcttcagctactaaacatttattacatccagatctctcagttctttctcttctgtcatagcatcttctgtcattttaacacttctctttatctaaaaatgaattacagaattggtgagtaaagcatcatgcaatagaaggtagaaagtagaaactggtcaaagaagtttcagacttagtttgaaaatggaaagtatgtactggaacctcctttaacacagagcttggcatgtgcttatagggagtgagcaggaccatttacagaagctgtgctgggctaactggctgtgggttacctattcacattaaccctggcaacatttcgagtgaccagatttactaatatggttaacttccatttatttaggcttgcagtgcaccagggacagtgctagaaacagttatgtttttaaaagctccacaatccatgaaaattaatcaaagaaagattttgttgtgaaattctgtatcttttggacactaggggtagtgtgatactacaggaccatttctatgagacaaagaacattctatatggagtgacaatataatttaatcacttaaaccagaacaatttgaaagtgaaagggaacattattaacagggagaaggaaataaacaagcagtatttctggcaaacccacatacggtcactgtcatcttcattaaggcccttgcctatcttatcaggaagctgtggaatggtggggggactaacaaagccagtcaccaactgagtgttgagtgccaaacactggccatggacagtgtcccacggggccagtcataagcaaattgggatgcaaggagatgaaagagttaagccaaggacctgaagaagacctggggtacaagtgctaagtctggaagggccttataactgagcaatgatgggggacctgaagatatcattcagaaaagtctagtcagattgaagagcatgcaatatgcatccaaagtcacaacttcagtcccctgctgacctttgaggatcgtgtgggcatttgtagggatgacttaaggggctgtcagaaaaactcctgcctgcctggatgccactgctaatgtttctcacaggcttttagttctaggatggcgcagcctctattataaatagagcaggcattctgaaaaacaaaaaggcccttaacctttactggtacacagaggttcccaggggttggacattatttatccaggaatgtagagtgcaaatagccatggcaaatgtgagaccattttttattttcctagttttgctgaatagtctcttgagattgtgttggtgttaatatatatagcctcactttgagggcaggtgactgggagcattctaagttataaaaataaatacatagtcccaatacatcttcaatgcactgaatttttgtctcaggctacctgcacaaatgaggaaaatagaattcttttttaaacacttcaaaattggcttcagacaattactcagaagagagaagaatactgtgaccttcagatgccagggtcagttcccaagaacactctttccgtggtcctttgtctttcattcaatatttaagaagaaatatcactataggcaatagagccatattcttatataacacttatgctctgaagagtgaggaaactgaggacaaaggacatagctaacaccacagaaagagacacactcagagtggggattaaagtttagttctcctgatttatacacaggttaatatagatttgctggtaatttggtagagtgtagacaggtttaaagctttggtgtcaattagacccaaatttttatcttgcttccatttcttctaactctgggaccttaaataaggccctctgcaatgagtaacttactacctacttcataacatggttattaagtaaagaattagattatgttgataaatttccttgcctaggattgaataggtttccaggatagccagctctcttcctcatttctctggatgaaatatttcccattatttagggtcaattcaactagctcaaatctcctccatccacagtccattcataggagaatacacaataataattctcaaactcttttgatgtaagaatcatctgaggcacttgttagcaatgcagcttcagcaggattaaagtgaagcccaggaatctgtattttaatctgcacttcttcctcactttccactctcacacttccactacaagactcagacacaactggactacagaccacacttggaaaaatcctaatagagagaaatggcttcaatgtactatctcaataactcctaaaccattctgtgcttcagaatcaaatatgatgaaaattcaaacaaaaagttcagaagtcccttaccccaagagacactaatttagtgagtggggtctagtgtatgtattttaataagttcactggcaattctgatgcttagccaggtttggaaaccactgctttgtctcacagtagtatggtcccacccattgtgatttcaatggctaatttgaactaaatcacccaaaaccattctgcactggacattacttctctacaagaatggaaagattttacaattaagtattctaatagagactttcatgaataagtcattactcacaggtgttcataatgactttactttccatagtcagctaggatttagggccagtcttcacttttttgtttgtttgttcaaaacacatgcacacacacacacacactcacacacacacacacacacactcacacacacacactgcacaggtgataacaaagttcttatgcaagaacatctcatgcaaacactcatttcattgtggaggaagataaaaaagaggcaccatggggctcacagattccaacttggtttttagagatgatgaggaataactgaatgggcaatttttaaataagcataacagcaattgtgtccgtttcacacctagatcagtaattgcagcccgccttcccaggtaccaagttaatataccaagttgacataaaggcaaacaaaactataatgtgtgtttcaccaaaatgtctattactacccttcacatattttcatcctgctgatcttcattgatctctacagttctcccaatcttggaaccatattcaatttcccaagtatatatgtataaagagacttcttttacttattctactcaacttcctgctcaaatctcgtctacatgcaccaagctgccaagttgtccaactttgtgtgagaaattccctgtaataccaggcctaccaaccagatcaactctagtcctttaggtaagatggggcatttagaccatttgatggcattccaatagaatgcacagatcacaaggcatctgctgtgcagataaccagctgtgtattccacaaacacactgaaattcatcatcactgcattttaggttacaccccttaattcccattgttgtagaaaacaatcaaaagcttttttctgcatttggatattacattgttcagaaacttcttatttgtattgaaccagaagtctaaacattgacttcaactctgctttgcaggaatgccttgagaaataagagggtaaatccatttgctgaaggatatcaccaaatacgtgaaatttctatctctccaacacactcctagttaatccactggattcttaattgagaaaaatgaccattcccaaagatagcttgattttatttagactattggctttcatagtatatgttttatggttttctacgaatattcactaccctcaataatctccacctacaataagctgcattgccaaagggtcctgccactgccaagtcatttgtttgtcctaaacttctttgttatattatttttacaaattcttaaaagaaataattgtcaataatcagttcttgagcatttactatgtgttttacataatagagatgatattaaatcagcatattttccattcccctgcaaatctctttgccttgaaaatcacatactctaacagtctcctaccattcatgctaagtaagaaaaatcaacccaggaaagaaagcacaaactacaacaaatcaatcttttgtcaactcaaagctgactctcttgagtccttagcaaatctaagtaaatagttttaaaagccaggatttgtgaaaacaaaatagtttttctgaattgtaatagctccctttacacatgttaaaatacaggcttatctagaccatggaaaatattatttgttctttttttttttttttttgagacagagtctcactctgtcgcccagcctggagtgcagtggcacgatcttggctcactgcaagctctgcctcccaggttcacaccattctcctgcctcagcctcccgagtagctgggactacaggcacctgccaccaggcccggctaattttttgtatttttagttgagacgatgtttcaccgtgttagccaggatggtctcgatctcctgacctcgtgattcccccacctcggcctcccaaggtgctggaattacaggcgtgagccaccacgcccggccaatttgttcattttcaagataatacctccattgattgctctattatgacaagcactgattgatataagtgttttgcatgtattcactcctttctaccttacaacaatctccatctcatttgttcactcgtgtgtcccaagctcctataacatggactgatagacagtggacaaaataaatatgtgctatgtgaataagcaactttatgaaatatatactggacagtatatatttctatgtacattttgcagataaataaacagaggcacagagcagttatgcttcatttccaagattttatactcagtagtaataactaagattcaggatagggaaagtgattctcctaaacttcaagtgaggtggtcaacgtcattagagccaaaacaactctagattctctaacttcaaacctatacataatttataggattttctgccaaataaaaataaattttgtgcacatgcacacataacaccaacacatgtgttcatgtaacagccagcagctttcctttcagaggtttcctaagaaacaagcaaaatcatagccataaaaagtgctttgaaagatataaaatagacccatgcaaggtgctataaaaataataatgattaaaatttatcacaaatttgcctggggccagcctcataggtctcgatctgtcttcttcactcctgatgccaattgccagctgcttcctgtcctgaattttgaatgatagccagattcttctcacatctgacaagtgagtcctactgggttctgcccaaaccctatccctcctactacatcaccatttggttggagaaggaaggaacctccatttattatgaattttatgtttcaggcactgtactctttattcactgacttaattatcaaatacttattgaacacctaccatgtgccacacactgtgccaaacagacctggatgacagtgagcaagactaaagtggcctttgtcttcatagcctagtggaaccatgccttacatgcattatattattcaattctacaagtaaatctttagatggctcctcctagaactgttcctctgttgtagatgagaaaatgaggctatgcaaagtgaggtaacttgttaatttcacatgaccacgtggtgaggttgtattaaaatatttaaatatgcaattgactccagagccaatatgaagtttctcttctttgtcaatttttgtcctactttgcctgcttttactgcaagttaacattcaactctcggttctttccaaagtcaatgaaagacttacagagagcattcaataagaattaagcttaagatgaaagccaaagcaaaagagatttggctttattgtctagaacatagtttgcctgaccccacccacctcagttcttctcaggcctgtgcagtgaaagtggccccttgacctagctcatctccatagccaagagcaaggaaaatgtgccaaaatgagcaaatacctctgtgcctagagtttctcaagatagagatgagtggccaacgactaattcctataaaaagtccttaagtgcatgtcttttctgtagttcttaagggtgaaaatttgacgtatctccagcttactagtaagttatctactaagatgttaaaggttttaaatgctaatattcataaattaaaatcagcatatcactagagtctcccaaagatatgaattccattttctactaagaaggctgatttcctcaaaatgtttgcctatgttacaccctactgtagctcagttaattcataattactgaaatttacagatacacaaaggaaattttgtcatcattgaattcctagcattgtgttgggttgatcatggttttatttctgccaatctcattttgtaattatcatttattgttaatttaacagcaacatcaatttaatctattgtgggttgtttggtttaccatgcagtatataataatgaatatatgcatttttttctaaatggtctaacacaaagctttgacatgcatacacaacaattcaaatatgaattatacatacttcactgataacatggatgtatacaccacaacagtttttttatacttcactgataacacggatgtatacaccacaacaattttttaaatatatggtgatgattggtgttgcccacaaatttgagtagttcaaaatttgccatatagggttctttttctcttatggatgaagaagctccaactgcaccaagccttctgcatataactatatactttagacaatatatgaagaaacaactacctcatgttaccagagagtgagcaaaagaaaaaagttctatagagaaggaaacagcataataagtatcacttttaaaatagatcgaccctgagggcaggccacagttggcaccactacatagctaaaactctgatagaaatcccaaaagaaaacctagcatctttctgtcctgaaaaattagagaacagagttcactgtaaccataactgctgtaaagtcagtgggggaggtctcaaaaaggagaaaacaagtgtgggaagccccaaattctgtatataaactccatccaagtctggctgacttctgaattatgcacacttgtggcaagctactaacagctaaaataagaataatagaactgaactaaaatttgcatagattccaaagggacacatttttcaatttgaacccaattaagttaacattctctcagaacaaaaatttaacaccttaagaagaatatatagaatagagtctgcacaatacaacagtgagaatgtccaagatatactccaaaattattctacatacaaagaaacaggaaaatgtgatctattctcaagatacaacataatcaacagagaccaaccccaagctgacccagaagttggaattagaaagcaattattttaaaaagctatcataatttgtgcccaatcatataaggaaaaatatgctcataataaataaaaatagaaaattaataaaaactgttaaaaaaaaggaaatcatagaactgaaaacacaatatctgaaatttaaaaatttacagtatggacataatagcagagtggagaatatagtagagtctgccaacttgaagataaacagaaaatatccaatctgaagaagacaaaaaagagaagcaaacaaatcctaaaaacctatagacaaatatcaaattatctaacatacatgtaattagagttgcaagagaagacaacccacacagaaaaagacgtgagaaaataatgactgaaatttctccagatttcctgaaagacataaatttacagattcaagagctcaatcaactcaaagcagaataaatatgaagaaaatctcacctaagcatatcatagttaaactactaataaccaaaggcaagacaatcttgaaagcagctagagaaaaaggacacatagcatataagcaaaaatgattcagatgtttgctaacttctcactagaaataatggaagccagtagagagtgtatcagtgtctttaaagtgctgaaaaaaaataaatgccaacccagaatcctaacctagcaagaatatccttcaagaatgagggcagaataaagacatttttagatagaaaactaagataatttgtcattttaaaagaaattctcaaaaagctttttagactgagggctatcaataacatgaaaactcagatcttcaggaaggaatgaagatcattggaagtactaaatgcctgggtaaatatcaaagattgtttttcctcttaattgttttatatgtgaagacttaaagcagaaattatactatcgtccttgcaggtttatatatgtgaaaaacatagcatatcgagtagcagtggatgagatgactctatcaggttggtgaaaaggtaattgtgggttttgccattaaaagcagccagatggatgctgaaaaaagggatcacttatttaacaaatatttatcgaattgatatatatgcaatgcattaatattaggtgcctagtacacagtgattaacaaaacagattttgtctttttcattaaagcaataaaaaagtagtaaaagcttttgagcagaggagtaacatggtaagatttacatttatgaaagctctctctttaaagaataggtggagaaagatgagaatatatgcaggaagaagaagtataaggctattgctatgactcaggaaagagataaagattgcttggatgcagctactaagagtgaaattggagacattgctctgaaattaatggatctgagaatattttggaagaaactgacagtatatgatgacgaattggttataaggggtgaggaacagggagtgactcatgggtgatacctagttttcttaggaaaagaaggtgaagcagtcaggtgaagatagtaccatttgctgagctaagcaatactagcaaaagtggggaccatgagttcatttgggaatattttaagtttgggctactctaattccctgaaaatatcaggtgcatagtttgatgtgtctagtcaaacttatacagcactcaagtgtgtgtttcaaaataaatattcaatacatattgatatgatttattaataaatattcaatatgtaactgactaaattgaaatcagaggaaagcaaacaaccatgtattaagtgttgactctgaccggcattatgtccaccactttatctacatcatctcattttcaactttaatattatgacttcaattttacagaattaggaacaggctcggggaaatgaaataatacaacaaaaaaaaaaactgtagactcaagactaaaactcatgtctgcctctacaaatccttctgaagtctttgttcttgcctctgttccctcccaccaccacataatacttattttatggaaaatgaaaaagcttcttccactctatcttagaaaatatctccctcttttcttccctacatgcatttcttttctcccactcaagcagggatactacagaatgaaattcagcaatttctcctctgcttctattcaagattaagggaaggaagcctgtagaaaaataaaaaataaaaaatggaaaatgctcccagtgctccaagattgtggatatacactcatttcatgtgtactcttcaaaactttcaaggaagctgaaatctaatttaatctattacatgattgtgctaaattacttaaccacatcaaagcatcaatggcctcacactctgggaagggacattgtaaaatggttttcaaatatataatgcagtctctcaggtgcctgagacagggacgcccatccctgaatataaagcttcccttacacttctgagatcaaaacaacagagccattatttgagaggctggatgaaataccagaaccatttcttattagctttagtcattaaagagaatttagtagcctggctatttatgcctcttttcttccttctttaaaaaaaaaaaaaggcaatcttaatggaatgaaagggcagaagattttaaagatcaagattatgagtaaatttcccactaattacactgttttctgcttttagaaaagaaaaacaaaaccaattttccaattccccctgcctctcatactaaacattttaagaaagcaaaggaaaaaaaagaaaaaaaaagatgttaagtatattgtccttcactaagagtaaagacaattgttactataccactagtactactgtaaatactagtgaaaagtatcccatgtgaatctgttctctagaatgtcaaaggcattttcccataaaaagaattttatgaacaaaagttggatctccagtaaggcccacaaaagccaagccagtcacggtgttgacatagatcagtattgaggcaatatctagaaatctcagcaacatcagaattacatctcgactccctctctttctcctgtcaacaactattttgaaagccatgtaatagtgagaatttagcttttgtatgaagaaaagagaaggcagtatagcttagcatactatgagcactaggactggattacctaggtttgactcctgtcactaaacacttcccagctctgaacatgagacaaggcccttcccttatgtgggcctcggctcccacatccacataacagggattaaagtaggatccttagtgttgttgtaagtaagttattaccttaaaacacagagaataattccaggcacatagtgagtactcaataaaagaatgctattgtcagggcacgatgcctcatggttttaatcccagcactttgggaggccgtggtgagcaaatcacttgaggccaagagtttgagaccagcctggacaatatgatgaaacccaatctctactaaaaatacaaaaattagccggccatggtggtagtccatagtcctagctactcgggaagctgaggcacgagaatcacttgaatctaaaaggcaagggttgtagtgagccaagatcatgctaccgcactccagcctgggtgacagagcaagcactgtctcaaaaaaaaaagaaagaaagaaaagtccattattattggtactgtcatacatattttatctaatctttgccattatccctcaatataaatatatttatcttccatgtcatagatgaagaaactgaagcctagagaagttacgtaattttccagggaaacacagtcataaaagataaatgtttaaagatagagccagatttctgacccagtcctgatacccaaactccaggttctatcatgtatggccatcatgcaatgcctgtgaagatgcagggttctcaaaaacacatccttcccctgcctcccaatccccttcactaattcctcagccactgaccccacaggaagaaggaaagacagatggcaatcaaaactctttctccctttccaggacccacagaaggagaaggctgccccagctctgtgcctagcaagggccaagcttccatagatatttgacctttgtaaattaggcattcagaagtcaaagaatgcctgtatttaaaatttccattgtagatttctggcaaatccatgagtgtgagctctttgaaaatgccacaggcctgtggaaatccttgtgggtgtaattagctagagaaagtgaaggtgactgaccatttacagtcacatcataatgaaatgaagtattacagaaaccatgaagccaaaacactgggagggctgagacccacaaagtaatctggacatagagatgttttccagaaaccaactgtgaaagaactaagagggtgttctactcacaggcttgacactgagctggtccagtttcccttcacattcagaggcagaggctggagaaaagagaagaaaacccagatatgaggaataaaagcattcaaggcctggaaaacagatctcgtggcagtgggtttccttaggaacaagatgggagaaaaaggattttccctgatttctgggatcttctcacagctcccaaacacttcttaattattttgaaaatgtagttttgattatgaggaaggtccttttaaggaattacagaatctgaaaactgtaagagggattggcctttacagagcacttaccatgtgtcaggcattgtgatcccactataaatcttccaacaaccctgtaattattgtccttgcattacagaggaggctcagagagggttaagccccgcccagggtcacagagccaggatgcaggaccctggctcccagcctgcctgacaccacaggcagaggccttgctcactcacattcactgacttcctttgaagtcattttgtccaagcttcagcaccctgtgcaagtgccctgaacagcacccccaataggtggcttttcagtttcagtttgaataattgctgcaaaaagaagcttactacttctttttattgcagtaaaatacacataaagataaccaatttatttttgtatgtgggtacacagtaggtgtatatatttatgggttccatgagttgttttgataataggcatgcaatacataataatcacatcagggtaaatgtggtatctgtcacctcaagcgtttaccctttgtgtttcaagcaatccaattatatacccttttaatcatttcaaaatgtacaattaaattatgtttgactatagtcactgtgttgtgctagcaaatactaggtcttattcattctttctggttttttgtacccactaaccatccccacttcccactccccaccatcccactacctttcccagcctctggcaacagtccttctgttctctatctccatgagctcaattattttaatttttagctcccacaaataagtgagaatatgcaatgtttgtctttctgtgcctggcttatttcacttaccataacgacctccagttgcatgcatgttgttgcaaatgacaggatctcattcttttttacagctgaatagtactccattttgtatatgtaccacattttctttatccatttgtctgctgatatgcacttaggttgcttccaaatcttgggtattttgaatagagctgtaataaacatgagagtgaagacatttcttcaatatattgatttcctttcttttgggtatattcctagcagtgagattgctggatcatatggtagctctatttttagtttgttgaggaacctccaaactgttctttatagtgcttatagtaacttacattcccaccaactatgtacaaaggttcaaaggtaaccattttaaaacaaacaattcagtggcatttagtacattcataagtttgtacaaccattaccactatttagttgcagaaaattatcatcatcccaaaatgaaactccatactcattaagctgccactccccattcttcattccctcagccaataatttgctttctgtctttatgatttgcttattctagatggctcatataaatagaatcatacaatatgtggctttcttatctaacttctataactcaatataatgctttcgaggttcacccatgttgtagcatgtatcagtacttcattccttctaaggctgaataatagtccactttatggatataccacatttttaaacacttgttttcaataattttaggtatgtaactaggagcaggattattggtttatatgggaattctatggttaacttactgaggaaccaccaaatgttttccaccacagctgtgccattttacattcccatcagcaatggatgaaggttccaatttctccacattctcaccaacacttgatattttccattttgttttgtttttttaattatagccatcccagtgtgtgtgaaggagtatctcattgtggttttgatttgcatttccctaatgactaatgacatcaagcatcttttcatgtgctcatggccattgagatatctcctttggagaaatgtgtattcaagccttttccccattttcttaactgggacatttgcttttgttgttgagttataattctttatatattatggatatttgtcccttttttttttgagacagtgtcttcctctgtcgcccaggctggagtgcagtggcacaatctcggctcgctgcaagctccgcctcccgggctcacgcctttctcctgcctcagcctcctgaggtagctgggactacaggcgcccgccaccacgcccggctacttttttgtatttttttactagagacggggtttcaccgtgttagccaggatggtctcaatctcctgacctcatgatccaccacccttggcctcccaaagtgctgggattacacgcctgagccaccacgcccagctgatatttgacccttaacaggtatactatttggaaatattttcctccattctgtcttctcactgtcttgatattgtcctttgattcaataaagtttttaattttgacgaagtcagatttatccattttttcttgtatggcttatacttttggtgtcatgtctaagaaatcagtgccaaagccaaggtcagggagtttactccatgttttcttctaagagttgtatagtttcagctcctacatttaagtctttgatccattttgacttaatttttgtatatagtgctaggtaagaatttaatttcactttttttcacatggatacacagttgtcccagcaccatttgttgaaaaggctgttattttcctattaagtattcatggcacccttgctaacaattaattgaccatatgcgtatgggcttattcctaaactcttaattctgtaccactgatctatatgtctatccctatggtattaccacattggttttattaattaattaattaatttatttattgagggattctccctctgttgccaggctggagtgcagtggcacgatcttggctcactgcaacctccacctccagtgttcaagcaattctcctgcctcagcctcccgagtagctgggaatacaggcacgcgctaccacatccagctaatttttgtatttttagtaaagacggggttttaccatgttggccaggatggtctcgatctcttgacctcgtgatccacccacctcggcctcccaaagtgctgggattacaggcatgagccaccacgcccagccaccacactgattttaaaactgtagcccactactttttaaggcaaactactcagccttcagatatccccaccccttgttagaaagttatttcttaccctgatagtactaatcactgatcctaattctgccctctagagtctcattatcaacaacaacatgatcactaacgtttctaaagctcttattgttttccaggtatgtcctaggtgttttatatgtattgtttatcgcattgtgtcttcaaacactataggtacaattattaccctccgtgaagaggtgaagaaactgtggcatagagaggttaaatgaccaacccactcacagttacataataagtggcagatccaggatgcaaacccaggcattatttcggtattcagttcacgcttttaacctacagagcagtagagccaattcactgtgtacattctgggtcaagcactgtgcttagggcgagaagtgcaaaggtaaataggtcactaaccctggatcatggagttcacaaatcagcagaggaaaaacatggtcaatataaagtttgcctgtggagggtgttgcaatgcaggaataccaatgatagatgttttccctgggaaactagaagacatcacaggaaaggtgaacttcaggatagatcttgaagcacaagcagaaatttgctagagcataagagggaagagcagtggaggcatgacctattgtaaaccaatcccgtaagatacaaatatgttttgacaatatcagttaatgactttacatattttcctccaataatgtcatcttgatgaagtcagtttcttaatcctgtatacaaaatcctttttaactctgaacctctctgatatatatttgctttcattccgcctttgtattccctgaaaataagatcgtttgcctttcatatggtagtctaagcgtctattctgaccaaaagtacaccaaagtcttgagatgctttggttttcttaaggaaaatactttctttttaaattttgaaggatcaccaccagctctcaattttaatcagctcataataaattccttggggaaaaagtagctttcttctaaatcctggattcctcctgttcctaaaataatgaaagatattgtaggaaaatcataggctaggttatagtatgtcaaatttgttcataatagcagctcacttgagaggctaagtgaggacctctgagggataacacaggcctgtgtcctttgaaatctcccatttcccagagtcttgaattgtgtttctctggaagtccctcagctgctggctcaattcatacgtgagctgtactcttctggggtaaagttgttaaacagagagagaggtacagagcccctgagggactatcagctaaaatgctagccatgacctggtgaggggatggttctaggatagtgctttgctaagtagccaatctgtcaaagattgccaagatgtggtaaggcgattacatcacaatgtaaatccatgcgttgcttctttcatccaaaaagtcttgctacaaaaagtatataaatagaatcaagcagtgtgcttaattacaaagttgatttttagtttggctcgaggtctttttcttatcgcagaccagtaacggcttataaactgacagggtccagggaccactctttgaggagcccagatctgggagaaaaagtcttctcaaaaaggggatagatttcactctccctcatctgcaactttgtcacctagggtgcaaacaaagtggtgtttttcttcactcaggggaccacccacaaatccacagactgttagtcctgccttcttagccaatctagggatttatacagctcaggtgcagcatggaaccatagaaagcacacagggtctggggttatgcaaaccaagtttcaaagccaattttttccaccctctagctttgtgacgttaaacaatatcctacttctaaactttaatgtccttatctgtaagtgggatagtaatacctacctaacaaattttttcaattaaatttataaatatgtatcaagtattgtgtaaatgtcatgtatggaagagaaaattcaaatttttcctactcttacctccttctccccttgctcttccttctttcccttattaagcccatgaaaaccttctataagaatagatcagtatactctgtccctgctcttattattaatgcttacattgattgaactataaaatatcagtccctcttacctaagacccagatccctccttcaaatagtttgatttcaagccctaggtgtaacttaacctcccattcccctttcttgcccagggtatcctagctatagcaaaagaaactctgacttttcacatttttatatctctttttctttctccaaccatttattttccttctttctaattattccaagtatagattataaggaactataagaatcaaactctactaatttcaccaaaacatagacccttgcctctcaccacgctgccctatcccaccctcaccatccaaactaatccaagtccatggtatcactgctaatataaatactcccctccttcaacaaaaacttcaactctctggaccactgatgctttcctgagcatcaaataactctacattgacctagaacactgagaaggatcatttttcaatagagtcttgacgtcatacatacatgctcatattagcattcccaaaatgagtttttcatccatttcccacagttcctgaaccttttccattataaatctttccattgataaaggaatttactcaaagatcaaatatctatgcctgtaaagaagtaagtagaggccacgtgcagtggcatgcacctgtaatcccagcacttcaggaggccaagatgggcagattatttgagctcaggagttctaaaccagcctggggaacatggcgaaactatctctacaaaagatacaaaaattagccagatgtggtagtgtgcacctgtagtcccagctactcaggaggctgaggtgggagaactgcttaagcctggaaagtcgagctgtagtgagccatgactgcaccactgcactccagcctaggcaatagaatggagaccctgtttcaaaaaaaaaaagtagtaaatagagaactacatttattgctaggcatttaatacagactgtctcactttatcccccagaacaacacaatagggtaagcattattagccccattttacatatgagaaactaagacttacagagtttagaagtggcaaaattaatatttaaactcaggacagcctagtctccagcaggaatccctttgatagcttcctttaaaagggaacatttagtttatgtttaactacatcctgggactgaaagctccacatttgacccaacccatcatggaacttctctgattctttgaaagcgttggcgtctaacaatgaaggcattctggaaataaaactggctgcttcaggggagtggtggtctccccatcccagcaccgcctcagctgcccaaaggcctttggtttgtttcaaatgcagattctcagtccctatttagctaacccattctcatgtgcgacacaccaaaggtgataatccaggaccaatctgaattcttaaatcactctctaaaagcaagaaggacaaaaccagtaagaaaagccgtatttactttgccactcttcccagaggcaagggcattgcaagcaatggagagtaagaggaaaattaaactataaagaattatttgacagtgtttctttaatcgtggtctacatctgctgatccagccaaaagcaagggggcagaggtgatctttgctatgccacagtgaataatgcaatcatatttttgataccaaactacatttaactgccatataaatcctgcctgcctcaataccacacctcattatctcacaggaaatgtatggcttcttgaaattcaaatgtggtcagatctgtgcctccaaagctgagatacagacacaaagtggagagtcatatgtttgcttcaccagccagtacagcttcctaagtgcacataacaagccttgcccagctatccttggcactaacttgttgtggacatcgggcaaagcactctacctctctgagattccgttttctacttcaaagtgggagctgggatatcgttattcccattttgcaaatgaggaaagtcagagaagtttgcaaattgctcaaggtcacagtcaaatatctagtcaaagggaatattgacatcaaacccaagtctgtcttgactcacaagcatgcttttccaaaaacaaaaaagctctaacaccatggctctgtggtactttgctacaagtaataggttcagaaatccttaacaatggcttccacaatttgagacatcttaatctcaacagagtgaacagcccagattcccaaaagaggaaaaatgtgtgaaataaacacaactttgtaaatgttcaagattgatttcagggagtacggtgggggtagctgaggtgattggtacagaaatggaaagagaatgctttctcaatgtctttggacagcaggaggagggtgatttggaaatgactctgcctgacttgagaagaaggaagaagcatgctgggtcatttttgccttgtttctagctgcatgaattgaaaagccaggcccaggttcaatgcatcattcttgaagcagtgaacaaaatccctctttgttccccagtgaaacttatctctgaagagctgcactacttcctgtgagatatagccctgcagatgtgtcgtgggagacccgcccggctgcactgccttccataaaagtgcaagaatgggcactttgtactgctggactgaaaatgacactcactcttctgatccccactggggttaccaagtgggcaaaacttcctgcttagaggaggggtcatagacagcagggggagtgtgtgattttgttttgttcctttgtgaatttgtttagctatttatagagctaaaggagaaagcaaacgggcacaatgtagcacagtgtttttcaaagtgtattccatggaaccctttcgtgggttgcagaccccaggggtggaggcagaggatggggtggtgacagcagcaggtgctgtccagggccttctgtctccctcaccccctacactaactacaacctttagagcagttctacttctaaccatgtaatgtggtgggctgatactgtttcattcaaagactttcacagtcaaaaaagtgtttgaaaaacacagatgccataagaagatcctataggataagaatcatccagaattctattctcaattttcttaaaatatagatgtgtaattttgagtcattcatttcaaccctgatcttagtctcttcatcaatagaatgaggaggttctgacagcataaaacttttaagtgtgaacactgcactatgcttataacacttatcagactgattccaacagagaggatcctccacacgtattcactttgatagatatttattaacatacacttggagtcaggcaccatcttaatcttggggaggcaaaaatggaaaacaaaatgcctgccctaaagaagttcacagtctgagctacagacaggaaactaatttaattattacaataaaagatgaaaggtgctatgttcagagaagggttagttatttcgaaacgtggataccaaaatgttttctgggagaactgttgaactaactctagcataaaagtagcctcagaccttaaataagcaatctactctgattttagaagcctaaagaaggaatacaggacaccataagagatagtcaaaggatagctagaacaagagcaaccctaggtgacaataatttagtgtccaggatagtgttcaaatcagccatcatacgttacctatttagaaggagctaaaaagaggaaggactctagaagggagaaaagtaaacacttccaaaatgcttacctttactcttgccatccctaagttaagggttcatgggctgatcctttgcactgcacaaaatacaactgtgttatatcaggagcttaaatgatggccccgtggttcaagtgaaatggtttagttaaaagaacacttgaagcaaacacatctgggctatatcccagccccaccacccactagctgtgtgagttggggcaatttgtttaacttttgttatcctgtctttctccatttgtaaaatggaatggtaatacctactttctgggattagtttgccacccaggtctggagtttcctcatctaaaaaattcatgaattatattagatgttctctgaggtcctttcaagcactaaagtagtttttctgaaattgctactagagtataaggaagttcttcagtgcaggctgaattttcaccacaaaaaaaagatagtaggaaaagcatcaaatgctttggaatactttagatcaaaggaagaattggttacaataaaataaatacagctttctcccagaaaaataatcggaaaagaaggaaactccctgtaagatgatttaattttccattaatgtacaataagaggctctttctgacattcctaaaattaagtgggtaccagcagacagtacttgatacacagaaagccactgttggtgctattaaaatttatgggctatttaaacagtgctcttataagggacattaatttttctccagtgggaaaaataagctatataaaattgatgcctagataatcaaaaagggggaaaagactgtgcagttgggaaaaaataataagagagcatcaaaattttctaattctgtgttcatgtagtaactattaatggcataagatatgaatgtatttatgctggattgttctattgtcaacttgttaaactagaaactttgtgtcctagaattccttcttaatatgattctgagttcaggtcagttaaaagaggaacttgtgtgagatttgagtagcagaggttgaataatgagcattactctttgaaggtcatattgtggtcagacacacagacagacacagagatccagtggtttccagtttatccttactcttctattcatgtccaattcttcttccataccccaggctttgttgaacaacagcagcccaggcttactgtcaagacactgctgggagagtcacacatgcagtagctacacagaggcaacaactactcgctaatttcactgtgagctgcttcctcatagtcctacctcagtggctggtcatgtttgccttcttgagtacccctgcaagctccagcttgtccggttgcaccgatgcttcaaaaagatcggttagtgacacatttctctgatacgtcagccctctttctggagcttcatttcatcagctccttccacaattgtataaagtctaattcctataaccaatcccttatccaaacactcacaggagctctgcttccctgacttgtccctggccaataaagaaaattttgcataaaagtcaaaagctgccgtaacataaaacataaaatatgtggcattgcctttgagactggcaagcaagcagaggttggaagagcaattaggacattgttttcagggactaaaagagcagtgatcaaattgttcttggagggcagataaggagcaaaacatatcatataatagtgaaacaattggcaaagctgtcacttgtggtaatttggaagacagactatatacctaataatctagtggacctgcctaaaaagatttccaagcagactctttttttttttaattgaggtagggtcttgctctatcacccaggctggagttcagtggcacaatcacagctcactgcagcctcaaccctccaggctaaagtgatcctcccagcccagccacttcagtagctgagaccacaggcacacaacaccacacctggttaattttttcctattttttttgtagaagcaatgtctcactttgttgcctaggctggtttcaaactcctggactcaagtgatcttcccattttggcctcccaaagtgcttggattaccggcgtaagccaccatgcccagcctccaaacagacttttgaaagcctcatttggcatctttttatctacatacaataaggtgcattaacagagataagaactaaagagaaaaatgaccaatgttcaagcagaagttttttcatctatatgcaaacagtactggtatgagcaaacactttgtgtgtgtgcatgtgcacatgtatgtgtgcatgtatgcacatctcaggatttactgaattgtaaaataaaactgtttcacattcccctagtcttttgaaccagtaaaacattctaaaattaagaattggcctcagggtaataatcaaactaagcatgtggttataagatgctttattaagacctcaggaaaatttaagttagtgactaataggttccctcagttagcaaaatgagagttaaatatcttaaggatatcgaccaataagactcatatttgcaccataagataaaagtatttctcaaaaacacatattgatacggctttgggacatggactaataaggtatataggaaactcaaaaaaattgtaacagacttgtactaagtaaagcactacaaaaatgagctgaaacaaaagggaaaccattcaaaatgaaaagagccctctggttccaaaactttctttttttaaaactttacttttaagttcaggggtacatgtgcaggtttgttacataggtaaacttgtgtcattggggttcaatgtacagattattttatcactcagatattaagcctagtccccattaattatttttcctgatcctcttctcctcccatccttcaccctccgacaggccccagtgtgtgttgtccccttctatatgttcacgtattctcattatttagcttccacttataagtgagaacatacactatttggttttctgctcctgcattagttaaggataatggctggctctgaaattttctatgcagaaatagactgataatatgctcatccgcatacacaggccatcacttatcaaaaaaagaaagacctcagagagctctgttgaaaaaaaaaaaaaaagaaatgaagagcaaaggagaacagtgagttagagaagcacactcagggagcagaactgaaccctagtcaagaaacatattttactaccggagtagggtgctctgacatgtaccctgctggattccagaatttctatggatcagctaatgctatttaccttccgaacccctcctttttgaatatgcatgtcttttgcagttatcctttcctaatatcactattgtatgtggggtgtgtgagggaaagagtctttgtctttttagttcataggactctggatcaagagcaaccacccataaggagacacattagaagaatctcatctccaactagacctaatgcagacagtgagataatagacttcaagcctatgccaaaatgggatgaggctgtggaactctttagagagaatggatatatttcatatatgcgaggaatgtaaataagtgtggccagaggatatactcaggagggagggtgtaaaaatggctacaaatcctttgaagttcctaccaccaaggcagaaagtctaatttctacacctctttcatctgggatgaccttgcaacttccaaggtgaagagcaagagaaatttgttttttattttttgtcttctttagcttcttagtgtttctaccctcatcattgcaaggtacagttttcattcttacctcgtaccctcttagaacactgccactctatgaatagaccccaggctagcctccttagggataaaacattacgtgataagaaagacaagtagagatagagaaaagcagcattcacaactgctgcagccaccctagatgagtcccagttgtgccccagatacatgaaggggccatctggaccagccacttcctagaaaacccaccaattatctgaaactgcatgagtgagcccagtccaaattgccaacccacagaatcatgaataaataaatggctgtttgaaaaaccactaatttttaggtggtttgttgtgtagcaatggaaaactgaggtggtttcagcaacacaaaactttacaactggaaatctggaattgattgtatggactagggactagggtaagacaagtgagttacttagatgcaaacattaaggagacactcactctcagggtggtgcaagtgctccttatgttttataccctagatatttgtagtctcttccctaaatctagcccctggttttctaatctgactcgattaaaaggcattaatggccaaattgtcagtggtaaaagggacactgctaatccacagcatgaagtggaaaattattccctaaattatcatctgtaccacctggagtcaagtgcctatggaagagaaggtctttgggtgaccaactagctgctgccttagaatattttagtaaaaacagagagttggtatgttgttcctaagagtgatggagaacttggtgagggagcagaaatgatgaacttagggctttaaatatccagttatatgtctggttaaagagccagaatgcttctaaactaaaagaaaccctatctcctgtaaccacagttagagatttcagaaaactaaaccaaaaatctaatcctaaaggtatctgaaatacaacacaaaatgtatcataagcttataggatctcttgtattactgttaaggtattgaatgggaaagggtgagacccttgaaaaaggatggtccatgggggcagattccagtgaagttgaggaccttgaccaaactcaattcttccgagaatcctttggcagtagaaacaacacttcatccatgatgcttttagaaaaaagcatggtaaaggaactgaaacacatgatatcaagaacatggctggaaatgaggttactttgcctaggaaagaatacataaacaagaacttgagagtagatgcaaattatatgaagggctataatccaaggctacagtaactaaaacagcacggtactggtacaaaaacagacacatggaccaatggaataggttatagaacccagaaacgaagccacatacctaaaaccacctgatctttgacaaagccaacaatagcaacaatggggaaaggactccctatttaataatgatgccgtgataactggctatccatatgcagaagatgaaaactagaactctaccttttaccatatacaaaaaccaactcaagatggattaaagacttaaatgtaaaactattaaaaccctaggagaaaacctagaaaatatcattctggacaatggccctggcaaagacttcatgatgaagactccaaaaacaattgcaacaaaaacaaaaattgacaagtgggacctaattaaactaaagagcttctgcacagcaaaggaaaccatcaacagagtaaacagacaacctacagaatgggagaaaatatttgcacactatgcatctgacgaaagtctaatatccagaatctataaggaacttaaatcaacaagcaaaaaataaaaaatccaattaaaatatgggcaaaggacatgcacagacatttctcagaagaagacatacacacagccaacaagcatataaaaaaatgctcaatatcattaatcattagggaaatgcatatcaaaaccaaaatgggatactatcgcacaccagtcagaattgctactattaaaaagtcagaaaaaaaaatgacaaatgctggcaaggttgcagaaaaaagagaatgcttatacattgctggtgggaatgtaaattagttcagccactgtggaaagcagtctggagatttctcaaagaacttaaaatagaactaccattcaacccagcaatactattactgggtatatacccaaaggaatataaattgttctaccataaagacacatgcatgcatatgttcattgcagcattattcacaatagaaaaggcatgaaatcaacccaggtgcccatcaacagtggactggataaagaaaatgtgatacatatacaccatggaatactatacagccgtaaaaaataatgaggtcatgtccttggaagcaacacagatggagctggaggccataatcctaagcaaattaaggcaggaacagaaaaccaaatgctgcatgttctcactcataagtgggagccaaatattcagtacacatggacatgaagaagggaatgaacaatagacaccagggtctacatggtggtggagggcgggagtggggtgggggttgaaaaactacctgtcggtattataccgattacctgggtgacaacattatctgtgcaccaagcacacacaacatgcactttgctgatgtaacaaacctgctcatctaccccttgaacctaaaataaaagtcggaaagaaaaaaaaaaaaaaacaggctctgcttccaaaattcaagtgaaatgattatgtcaccaaaagatctagaggttagaaatgagattcatgtttcgggaacattgtaaaacagaccaatgactcggttgtgttttcattagactccttttttttttttttttttggctatgggcaaatgctcataaaatgaggtattatttgaatatacgaatgcaaattcaagaaagccagcaaagcaggtgaatagtttataagcgtacaaaatgaaccaagcccttcttcagccactcagtgtgtatacataccaaaagccacataattacacagtaattatgcaatttctaacttgaggcttcaatatccacactgaaaattatgtaccagttatatttggaactgttataaggttttagagaagaatgaaattaccatgaattagcaacttgttggcatctttaagaagactttaaatatttagtgttgaaatggacatgttacaagggtctgcatatgcattagcaacacatatcatatgtgcatttgcactgtatttataattctgtgtttgcatgaatatggatctatttacctcactgttgtaaacattcataaagattacatcttttttattttaggtaaaagttttgtttttctaaatgtgtttagcctgcacaatttagctgaagtgtttcattaataaaatttaaatgagtttaaaataaaatgaagaaaaaaactttgtaagaaggtagtattctgttactctgtaaatcctagctctgaaagttgtaggcacttagttagcagacaggcctaacgggagcttcacagagactaacagggtccttggcacacaaagtgctcaaccagtgagtggtggatagatgaatgaatgaatataaaagtggttcacatgagctttgggctagagttaagatcccttttccaaataagggaacgttgagtgatatttagaagattccagtggagatctagaaactacaggtgcatatccaagttatggactgttccaggcccctaccagggcagtgattttggacataagctatttttcattgtaacgaacattgctcctcatctagcacctactcacacatggcatgggcgtaaagtaagcatggtacaatagaaaatcccaccactgtaggatacctctgcaacatcctggactctcaccttccctctaaaaatgcctcaaatagtaggagaaaaaaatacagatgaataagagtttgggtttctccagttcttcgccatctccacaaagtggaatctactcacttccctaaggaaagcacagccagcaagagcagcagcaagcatttcctaaaaacctgccacgggtagactttcctcacggtgggacataaagatggagacagcattgtttcttctctcacagatgagcatatagaggaaactacaggagaagcagtcactgagagctggagcaataaagtgaggctttgcagacaaagtaagtcattaactgggcaataaaagatacagggggcaagaacagtagggccatgttagatagtgtagtccatgagaaccacaaaatttgagttaggaataggtatggacactggacactgagtagaccaatgtgactggacaaacaagggcagggaaacaattggaaatcaagtcctgcaggtttcccttaagccaactgttctcagttttggctattcattaaaatcacctgagaagctttttgaaaaacagaccgtatacagatcccattcctggagattctcatttaattggtctgggatgaggcccaagcatatttgggtttttgtttgtttgtttgtttcttgctctgtaggcaattctaacatgagacagggttgaaaatcattgtctaggtcatcagaatccaccagtgttatgcaactggcatcacttaaaagacagcttccaatactcctaaatgttttgcaacccaagtcccaaatccttggatgtaacggaattaatattttgtaaacctcaaaccaatgtcaatgtttcaattcctcacttagcagtcttctacctggaaggctgagcaatgaggcttaccgccacattgaaagagagcaggatatcaccttaaacagtggtatggggctcaaaagccatgatccagatattctgactctgtggtctgaggtgaagctcaggcatctgtgtttcccaagctctcctggccattctaacattcagatccactctcagaaaagagaggacactgagtttccaacccccaccccaaaccagaccaactaaatcagattcttggggtggaccaggcctgagtgttttgtaaacctcccatggtgactacagagtgctgccaagattgtttatcagataaagcggggattccagtgttttgtatgtcatggcacacgtagaaaattattctatttcataaggcacactggggtaaattagaagaaatttaggggcttggtatatgaaaatatggggcttggttttagaaaataaattttcattataatataactatgattttaaaacattagcaatgattataaatttagaatttataatttcaaaaatattttcacaaactccctattgggtactatgctcattacctgggtgatgggatcattcgtacccaaaacctcagcatcacacaatatacccacgtaacaaacctgcacatatactatttgagtctaaaataaaagttgaaattatatttttaaaaaatattttcacatattgtaatgcaagactggagcttgtgtctgtgactagaacttcattataagatgtttttgtgcctgaaatagttacacacagtctttccctgcccgcccccccaacccccaagatggagtctcgctctgtcacccaggctggagtgcaatggcgcaatctgggctcactgcaacctccacctcccaggttcaagcgattctcctgcctcagcctcctgaatagctgggactataggcctgtgccaccacacctggctaatttttgcatttttagtagagacggtgtttcaccatgttggccagtccagtttcaaactcttgacctcaaatgatccacccacctgggcctcccaaagtgctgggattacaggcgtgagccaccgcacccggactacacacagtctttatcaagatttttttttaagtctcttcaaattcttaataatcactatgaaaaagaagtctctcttctataagtagttgataaaaaaaatcaaaccacttttacaactgttaaaaaatgtgaaacagttaaagtaatacaaattacaattattatttgtcgattaaaaataaaaattttaataagattttaagggccttcttttctttcattgacaaagataatgaaatttattttgaaaatgtgaattggcaattgctacaaagagaataaaatacctggaatacagctaacaagggaactgaaggacctcttcaaggagaactacaaaccactgttcaaggaaatcagagagaacacaaacatggaaaaacatttcatgctcacggataggaagaatcagtatcatgaaattggtcatactgcccaaagtaatttataggttcaatgatattcccattaaactaccattgacattcttcacagaattagaagaaactattttaaaatgcatatggaatcaaaaaagagctcatatagccaagacaatcctaagcaaaaagaataaagctggaggcatcccactactggacttcaaactatactacaaggctacagtaaccaaaacagcatggtactggtacaaaaacagatacatacacgaatggaacagaatagaaaactcagaaataagactgcacatctacaaccatctgatatttgacaaatctaacaaaaacaagtagtggagaaaggattccctatttaataaatggtgctgtgggaactggctagccatatgcagaaaattgaaactggacctcttcattacaccttacagaaaaattaactcaagatggattaaagacttaaatgtaaaaccccaaactattaaaaaccctagaagaaactctaggcaataccatgcagaacataggcacaagcaaagatttcatgacaaaatcactaaaaacaattgcaacaaaagtgaaaattgacaaatgggatttaattaaactaaagagcttctgcacagcaaaacaaactatcatctgagtgaacaggcaacctccagagtgggagaaaatttttggaacctatgcatctgacaaagttctaatatccagaatctacaaggaacttaaacaaatttacaaggaaaaaataaataaataaaaagcgggcaaaggacatgaacagacacttctcaaaagaagacatttatgtagccaacaaacatatgaaaaaactcaacatcactgatcattagagaaatgcaatcaaaaccacggtgtgataccatctcatgccagtcagaagggtgattattaaaaagtcaagtaacaacagatgctgacaaggttgtgaataaatagggacatttttactctgttggtgggaatgtaaattagttcaaccattgtggaaggtggtgtggtgattcctcaaagatctagaatcagaaataccatttgactcagcaatctcattactgagtatatacccaaaggaatataaatcattatattacaaggatacatgcacacatatgttcattgcagcactattcaccatagcaaagacatggaattaacccaaatgcccatccatgatagactggataaagaaaatgtggtacatacacactatggaatactatgcagccataaaaaggaacaaaatcatgtcttttgcagggacatggatggagctggaagccattatccttagcaagctaacacaggaacagaaaaccaaacactgcatgttctgacttataagtgggagctgaacaataggaaagcgtggacaccgctaagggaacaccacacactggagtcggggggtgaggttgggggagggagagcattaggtaaaataactaacgtatgctaggcttaatacctaggtgatgggtttataggtgcagtaaaccaccatggtacacgtttacctatgtaacaaacctgcatatcctgcgcatgtaccccggaacttaaaaaaataagaaagaaaatgtgaattggtatagatataagtcaaattttctcaaacccagtattttaaacagtgatgaagctataaatatgctcgcatgattagagtagtaattctgcagcttgcttgaggccactcaaagggtacaaaaagaagatgccataccaggaccctcaaccatatcctattcccctcactcatgttccttgagctgagcactgcacttctagagcaccctcaaacagctccatagatatgatcagcaggatgttgaagtacagctccacgtttccagacacctgctcattgacactttcagtgtcacagtagtcataaatgttggctgtcatgccataacctattcagaccaggttcaaacattttatgggttcaggacaagagtatagctagaggtccatatactggatgtctaaattcaaaattcataatcaaactagtaaactgttgcataaactgccttctatatccctacattgacaaatatactttaatagaaacaaaaataaaaatatgtgtgaagctattatttttatgtcactgaaaataaaccactgttctactaataagtggttgatgtttgttgactactaaaataaaggaatacataatttataaattgctatacactaattccacaaaattttctttccttcattttggcaaaaaaaaatttatgctattataatcaagattgtcatataatttttgttcctttagtagtaacaccaaattacacaattattcctgagtcactgtagttcttaggtaagtttatactaatttcagtttagagaaaactcactcttcagaggcaggagaaactggcattatcaataaaattattaaaataattagattattatcttagatttagaaagatctttaaattttaggtagaatatgcaaacattatagtgggattacatatgataaattatcactatcatagaaagctttacaaactattataatttcattgtataaattatcacttgtctcatgattttcaccattttaaaaacagtaaccagatttaatagaaaggtgaagaatcagtatcagacatcgtacatgttacttcttcctatatataaatttcagggtaatataaattttaactattacaaagttaatagttcttcatctgccacctgtaactcctataaataccataccaactgatgtatctccagaaccagaagacagagaagcaagagaaagtaccctatatgtcactgggaagtgattctttattgagcaggaatatccatattaaagctttttgaaaagaaagattggacaaattgactaattcgcctcttcttttacctaaatgcttcagttgttcaaatatttcccacattctaaaatagggactagcttcaacattggcaatgacacaaaccacaaacctttaaagcatgtttcagggacgtatattaagagatatttaaaaaaaaaaaaaagtttttctttgaggtccagaagatgttacttgtaagaacaaatgtttacggttgcatatgtcagccctcaacaacagatcctgagtgacagaggtgcccatgtgctcttaaataaatctgtctttttgtatttgtggtatgtattatctttcaatacaaggtctagagcagggattcctatggcttaggtctaaagatgttattaaatctattcatgggaccttggggcatacttgctgggcaacgctgagagagaggatacattagggggagaactgcgtaaataaaaaggaggccataggtaggataataaggtgtgtgtgtgtctttgcacatatgagtgtggagtgagcaagttttaatttctcattatttaagagatatagaagaatgacatcatcaagatgggggaataggaaaccccagaccccattccccaacagaaacattaactaaacaacaatacacagacaaaaagtttttatgagaacctagaaatcagttaggaagtcacaatacccccaggcaatctcaaagccaagagcagctgcattgaaatggataagaaatttatttcattaactatgtcagcccctcccccaagccagcacatctctgggaggaaaagcccaacatacagcttcttttgtgacaggtagagaaaagaatgaaatgtatgttcaaagtttcagcttttgaggggctgcccaaggaactggtttctgtctcacctgactcggaagattcatgggaactgacatacattggatgcctgggagccacagagagcaaaagagagtcagcggcttgtggcagtgccagagaacttgtaatatcacagatagaaattagcagggcttgttgtaatcaagagtaagcacctagctgtggctttttccctgggaaaaaacaggagggtggtatgtgtgtctagcattctgccttttcagggggcttcctgagggacgagtttttgcctcatctgattcagagtcctaatgggaaaccaacataccttgtttgcttagggccagagggaccaaaaaaaaaaaaaacctaaaaactcagttgcttgtggttgcaccagaaaacttataatactacagatagacaccagagggagcaagagattacaagctctgaaaaaaacaacttgcaaacctctctaattgggagaaaccagagaaaacacatctccagaaaagatgtgagaggccctcacaacctctagctgaaataactggtgaagttatttccctgtatgaagtcagtgagtaaagactaggagagatggctgtttttcaaatgcatgaataccaatatagttacaagacacataaagaaatatggaaacatatctcaatcaaaggaacaaaataaatctctagtaaccaaccctaaagaaatagagttatatgaagtacctgacaaagaattcaaaataaccatcacaaagatgttagaaaaatggtaaatgaacaaaatgagaatatcaacaaagagaaaaaattttaaataaacaacagcaattttggagcttaaaaacacaagagctgaattgaaaatttcactagaggggttcaaaaataaaagtgatgaagcagaaaaaaagaatcaacaaactcgaaaacagatcatttcagattacctagtcagaagaacaaaaggaaaaagaaatgaaaatgaatgatgaaagtctaagggacttatggaaccccatcaagcagactaattacacattatggctattccagaaggaaatgagggaaagagagagagagagattgagaatggcataaagattatttgaagacacaatggctgaaattttcccaaatttggggaaggaaatggacatacagataaaagaagcctaaaggatcccaattaagataaacttgtaaaagtctacattacaatcaaattgccaaaagtcaaagacaaagagagaattttgaaagtgggaagaggaaagctactcaccatatgaaaaggattctacataagaatatcaatgggtttctcagcagaagccttgcaggccagcaggaaataagagaatatattcaaagtgctaaaagtaaaaaaaaaaaaaaaaagaatatggcaaaactgacattcaaaaatgaagcagaaacactgaatttcccagataaaagctgaaggagttcctcaccattagacttccaggcaatgctatagagtgtccttcaagttgaaagaaaaggatgctaaagagcaacacaaaaacatgtgaaagtataaagcttgctggtaaaggtaaatctataaacgaatacagaatattgtaatggtggtccataaatcacttttaattatagtataagagttaacacaaagcgtgaaggagaaagaagttaaagagtaaagttgtatgtgattgcagttaagttgttatcagcttaaagtaggttgttataactataagtgttttgtgtaagcatcatgttaactacaaagaaaatacacatagaagatacataaaggaaattaagaaatgattcaaaacatgtcactaccaaaatgacaacacaaagagagaaagaaaaagaacaaaaagctacaagacagaaaacaattaataaaatgtcaatcttaagtccttctctataagtaattgctttaaatgtaaatggattaaattcccgatcataagacatcaagtggctgaatggatttttaaaaatcaagatctcactatatgctgcctatgggaaactcactttagatttaaagacatatgcaggctgaaagaaaaggatagaagaaatatattccatgaaaatggtaaccaaaatatagcagaggtagctatatttataacagaaaaaataagctttaagtcaaaaactgacacagtagacaaaagaggacatcatataattataaaaaggggccaattcaccagaaagataaatcaactataaatgtatatgcacccaacatcagagcacccaaaaacatgaagcaaatattaatagaactgaaggagaaacagacagcaatgcaatcatagtagaagatttgaatacctcactttcaattatggctagaacatccagaccgaaaatcaataagaaaagagtaaacttgaacaaccctataaatcagatagatccaatagacagataaagaacattccacccaatagcagcagaattcacatgcttctcaagttcacatggacattctccagtatagatcacatattaggctaccaaacaagtattaacacatttgaaaagactgaaatcataccaatttccaaccacaatggaatgaaaactagagatcaataacagaaggaaaactgggaaattcacaagtacatgaagttaatcatatacttctggacaaccaagggaccaaagaagcaattaaaaggaaaactagaacatatcttaagacaaataaaaacaaaaccacaacacaccaaaacttatgcaaataagcaaaagtcatactaagaagaaagtttgtggtgataaatgcctacattaaaaaagaagaaagatctcaaataaataacctaactttatatcttaaggaactataagaactataaggaacaataaaagcaaactaaaaccaaagatagcagaaatgaaggaaaaaacaaagattataacagaaataacagaaatagagaatagtaaacaacagaaagaaatcaatgaaactgagagttggctttttaagagatcaacaaaaatgacaaacctttagctatactaagaaaaaaagagggagacctaaataaaatcaaaaatgaaagaggaaatattacaattgatgctacatcaataacaataattgtaagatataactaacaaaaattatatgccaacaaattatatgcctggaagaaatggatattcctgaaacatttaacctaccaagtttgaatgctgaagaaataaaaagaacaaacctaaactagtaagaacaaacctataactagtaagaaaattggatcggtaattaaaaacctcaaagtggatggggttaggaaaaaatggggagttgctgatcaatggtcatagagtttcagtcatgcaagatgaaaaagttctagagatctgctgtacaacaatgtgtatatagttcacaatactatgctgtacacttaaaaatggttaataaggtagattttatgtttttcaacacaataaaaaataaatttttaaagagagatataaacaatagctacaatctaaaagcagttagtcatctatactaatctagatcatccattccaacggtttttcaaactttaactaacagaggaataatttttcacttaaaattttccagtaaacccaataacaaaaccataaaagtagaactgtgtgtgttgagttgtgttgggtgggagggaaccagagctcctcattttatagacacagaaactgaggccctgggaggaaaatggattcaccccgaagcacacagtgagttaatggcatggccctggctacaatccacatctcctgattcccagctcagtgttctttgcattttcattaaagttcttgtgcctaatctggaaaacacccagataaccataaaaggaaacagatgaaggtacccacaaatgagctatggaaggagagggagtttttaagcctaatcaccagccaatagatttccagtttcaatggttttttaatatcaaagttgttttcattatttattaatgaacttttgttaacattgtttattatttattaacattaattaaacgaacatttgaaattgcacagaaacaaaaaaggagaaaaaatttataatcctaccaattatataaacaactcttaacactggaatatgtcttctgtctcttaaagaacagattgttgggttttcaccaaattgtgctcattctgtatgttcaattttgtctcatgcttttttcacaatattatagcataagcattttccatttgtaaataacattttctttcatgactacataatatgctctgaagtagtcatgccatgcagaagatttttttctaaatttgttcaccacttcaaataatactaaaatgaacatatatccgtgtatataatggttgaacaatgtgtatggtagtatactagaggtagaattgagtttaagaatttgaagatttttggctgggcgcagtggctcacgcctgtaatcccagcactttgggaggctgagatgggtggatcatgaggtcaggagattgagaccatcctggctaacactgtgaaaccccatatctactaaaataatacaaaaaattagccaggtgtggtggcgcatgcctgtaatcccagctactcgggaggctgagacagcagaatcacttgaacccgggaggcggaggttgcagggagccaagatcgcaccactgtactccagcctgggcgacagagcaagacttcgtctcaaaaaaaaagaatttgaagaatttgaagagttttaagtcttttggtatgtagcatcaaatcacatatattttatttatgcataattacataaacatcatttaaaattctggaaatagaaatatagataaaataatatttgccattatttctttgacctagaggcagatacctattgaatatcttggtatagttcttccccatcttttttgaaaataaatacatatgcgcacacaattaccaaattgaaactattgtgtatgagtgtgtaatagtttgattttttattaccatgtctataaataatacttagagaccaaacagattttattaattacaacatattatcccaatcacacagccaaacatactcccatttttccacccctagtatagccacatccacgtgcccatacccaagtaacagagagattacatacaagaccactcctaataagacaactctcaagacacaatcttggttgtagttctcactggctttcttctgagaaactgactcaagagtgaatataggcagttgcaatagcatttttctaactggaaacttctacagagctcaactcagaatgatacgccactgtgccagccaccaggaacagttttgggccctgaaatatgaatctctgcttttcatcagatgtttccaaaagcagagtggttatgacagaaactttggcattagactctcctgggttccagccatgactgtacctcctattgtctgtgcaacttgaattaactttacccctctaagcctcagtctctccatctataaaaatgaatgacagtagctgcttcataggtttgaagtgatgatcagatgagacaatgcatgtaaagtactcagcattgtgtcattgcaggcacttaattttaactgtaattattattttgaggagttctggcagcagctttcgactctcgctctcacaaatatgactttctctttcctcattgatctattaacagaaaatattttttgactgataattcccaaagcagtcattatggcaatgaacacagcagttcaaaatgttatcatatttatcttatcacaaatgttattaatagctcaaagcagttgaaattgtcattaactatttttaataaataagtatatttcggcacttaatattcccaggagctttatataacaatattttcctcaatcttcacaaggctgtgaagtattattattaccattttgcaaatgagcaaactgacatggacactttaagaaatttgctaaaggtcacaccagtagaagttgaacagccaggatttgagtccaagcctgttttaatccaagccccaagccccatccactgggccatggatcagcaaatctttttctgtaaaggaccagatagtaaatattttaggcttttcaggccttatggtctccatcataactactcgactctaccattatagcacaaaagcagctataaatgatacagaaatgaaggacatgactatgtccaataaactttattatgggcactgaaatttgaatgttatattatttatatgtgtcacaatatatgactcttcttttcattttctatccaaccatttaaaaaatgtaaaaatcattcttagttcatgagccatataaaaaatagtaggtggactatagatgcatcttcagggagaatacaatgatcaggaaatgtggggatctctagccacactggacagttttcaggggtgtgatgctactagactctccctcaggtcttttctgttattcttttagctacaacactccttctacccctcctccccagcatctgcctttatctgccatacgccttgtcatccttcaaaccaaagtagcttcgctgttactagttgcaggaaatgcaacaaacccccccttaccgccacctccatactaagcgaggtaccccttttctgctctctcttagcaccctatatgttcccatcataggatctatcacaaagaattgggacaacttgggtacaagactgtctgctccaaggtcaagtgccataaaggtaagcttctgtcttggtgataagtgtacccacttagtcattagcacagtgtatggattataagggaagttgaataaatataggaatgaagaacaagtgggagaaaggaaagtaggggagagacaaacgaaagttcttaactgtaaatacaagctctgaacaggataaggagaggtggagagagtaggagaggaacctacacctggccattagggaaaaggtggaaaattgccaaacatggatgtggaaaccctttttctacttctcatgaggggcagtccatgatcccctgtaaaagggtgtgttcattatgttgggacaatgaagaataaggcaaaaactagtctcctagacttgtcccaccgaggaccagagaagagacactaactagagaatctgagtgcccatggattcctgagtaatttacatcatgttcactgccagtgaaatgcagagatggcagtggctcaaaaattaagatggcttctttttaaaatgttgtaacaaataaaagaatcccactgagaacacaaagaaaaaagaaattaaagagccaggaggtggaggtatgagggggtagcgactctaaaagccttctttcggctccatatcaaacagatttgctctttttaggagattatggaagcttgggtttgttctccaaagaactgctttgaagcaaagagtttaatcatcacacaccattaatgtttcagatttggggtttctctttttttcttttcttgactgggtgctctaagggagagtttctttgagatgaaaacatgtgaaataagaaacaccagcggttcactccactgctgctttgtgcttcctctcccgtctcccaaatcctcttcctcacaggtacaaggcctcagagagatgccaacacctgcttctaccacgagactctttaaaggctcaaacaaatatttgacgagaggtgttcagagtcacactccaaatatctattttattcattcactgaactcttgcatctgccaagaaaggtgacaatcactggacaactgaagaagaatccaagaaatgcccaacattgccctcattgtcttatcttcctttccccatcccctgttgtttctgaaggagaagggatactcctggatctaccaggttcaaatagggcacgaagcctactcactgtcattggagaaaagagttgagctatggaccataaattctaagcccaaatttgccactaactttaagtaggccatttgatttctctgggtacaggtggatcctgtgacaaacaatggagattccctcccacctattaggaatattagtagctgacagctctcagctgaaactcctttgcattttttctttgcttggaaagaattgtccagcctggagtctcttccttttccctgaaaatagctctcattcaattgctggtgatccattataggagtacagtatcctcatccccttgccctaatttgggacagttctgcaatgccatcccagtttccacatttcctgtaggattagctagaacttcgtctagccatctcctccctctgcccaattttccttcctttacttacctgcaggtgttgatcctgatggtcatcccaataaagttcttgcacacaggtcttcacaattctcatacaagtctcaaagtctgctttcagagaacctacctgggaccctgacccatagcttccccatctatgtaataagaggactctaccagatgacctccatttctgtctgtaaacataagtgaagtacaatgatccaactgccaggtctataacacaatcagcagaagcagcagcagcagggactcacatgcatctgaatgcaattgaattacctgattcagaacacgtctttcaaacactgtgaaacaatcagtgaagtggcagagacaccaaaaattggggtctctaggttggaaccctatctctgtcactaacttgctcagtgaccccaggtaattctctctgctgggcttcattttcttaaatacaaaataagaggctttatcatatttctccccctctcttcattttagatgaatttatgtgacttctgctttgaaaagaaaaaaagttcatttttggaaaaatcattttgtcattcaccatgaaccaaaagctcacattaagcatcttattattcatgactctgcacagcaccctcttcagtccttgcccttagggaatgtgtggtctaaggctggttgacctctactgggagtcacgaatgaggcatactctctagatcaatgtgccactcatccacaaaggagaaacctgctataatttacaaggttatcacatattcaaagaataactaaaaggaaatagaaactaacacacattgagcactgcctaagtgcctatcacagacttttgtcctcttatgtggattatagttcatttacttctgacaacagtccctgaaagtctgccatcaccatcccatttcagatgaagcttgcggagagggtgtgacaacctggagtcaagcagcgagcatgtggaagaaccaaggctagaaccccggcgtggttctgccacaccgtaatgtacttgcctgctcctctgtctcctcagtgagagttgggagctccttgagggcagcccctattgctttcttcttcatatcctgaacacctagcatgatggcaagtacctgttactaaatacaagtttataacattacttaattaaggtctcttgacttctcctattgctatttctatcacactatcatgcaatcggccttgctacttcgcctccaaatttttctaaaaattattcatcttgagacaggcagaagatcaatctcaaataacaaacatgcagcttattatggtctcccaacttacatggtgatatgagtcatttggcccccttgggatttaatagctggctgacaagcctcagcactgtcaatgtgcttgagattggctcacttgggccagctgggcaagggtttccattgattattcctaaaaacccattatgcttttgaaagccatttcattttaagatggtttaaatacatccttatcatttttaagcatgcccacaaaaagcatcctaaagatatttgatcattcaattacactaaatgaggccaatgtatatgctgctgcctcagaggttatcatgcttaataaaacgtactttataaaccccatgaaggctgtaattaaatttacaaacagccttccccacaactttaacaaaagatatctgaatggtgtgtgtgtgtgtgtgtgtgtgtgtgtgtgtgtgtgtgtgtgtgcatgtgtgtgtgtgtgtgtgtgtgttttaaagtgtcctgttccataaggattatagctcccctgctgtttggaaaagacaatttcacttgtaacactaataacttgagcaggggagaagctggcctggtgaatggaatgcacttcactgcacatcttggctcagctagaaatcggaaacagatggtccttgcggctggtttcccactcgagcccgctcactgccagcctgtggtcttctgtgggctgctgctggcagtctgtgacttgaacatagtaggacagtggcaaaagaaatcaaatcttttccaatgagcagcaagttgtaatgaaatttgacagatctgacattctatacccaacatctagttagaatatattaacctttagttttcttaagcgccttgcatagaagttgtgaatatacttattagagggttatgttgtatgtgtttttttttttccttttttttcttttttaacagggggcagagggtttagtccaatcttgggtggcagccggttaacagaaaatgcagagaaagtaaaagtcaaagaatttctaaatggaaatgaggcacaagatctgccgccaagaagaaaactgattctttgcaggacattgtgggtgagtttctgccaaaaataaattatcaatattttccttgcacaatacagatagattgattgagcaataaatatatatccatatctacatatatgtatatataccagatcaaaaatctgagcaatctctgggcaaattaataaaatagatggggctgtctggaccctctggcattttcttcaattctgcccttttcagctttgcagcattcacttctgccatacggtgagaaaagcatgccaggtgacctggaatgctggtttctttaagtcaccacactcacacccagtaatgacatgtacctgtgcagaggattttgctgccttcatcaaaaaaggataaatctcccaccagagaccttcacactttagagctttagaggaactagactttctatccttttgtgttgattcttctttttatcccaatacttaacgtgtgaatacatcctgactcgaaggtttagatggtgatggcctgaacaccatcttaggattttccacctgattaaggttagaggaaagatctaggtgttaatagtagttaatgcctcttaatacagcttttattttctgttctatttttttctttctttttaatcttggatacccattgctctaaactgaacatttctgcagcttcagcaacagggtacatttctaatttcatgttttccatgagcctggtgattcaaggccatacatatctgttaagctcaacattcaactctacataagaaataaaaaatatccaaggcaggaagatcacttgagaccaggggttcaagaccagcctgggtaacaaagcaagcccccgtctctctaaaaaaaaaaatcaattagccaggtgtggtggtgcacaactgtggtcccagctacttgggaggctgaggtaggaacatcagtcaagcccaggagttcgaggccactgtactccagcctgggtgacagataaatcttatctccaaaaaaatgaataaaaaataaaaattgtcttctgagaacaagctggttggaatagcaaaagcataggcttttcattatatggacatagggttgaatcttggctcttgttctttagcatgtgtctttagccaagactcttacctttttgaccctgatctgcaagttaaaaatcgtaataacaacctcctatggttgttgtgaaggttaaacaacatatcatacccaaaagtgtgtttaaaaactgtatgacatgtaacaggtgctaaatcctgttacttctctccttttttggttcaggaggcaacaccagagtggtgaagctctgaagtcatcattccaaggcttgaatcctccttccatcactaactctggagccctaagcaagtcactttacctcttggagtctgttatcctgtttgtaaaatggagttaataataggttctacctcataaggactcacatggaaaaacacacacacacacacacacacacacacacacacacacacacaaagatcttagaacagtgcctggccaagaggaaacactcagtatacgtgagctgttacatacgaaatcaaattgctcttcccctagactttcaaatttccaatggtcctagaaacagagcttgaaaagaaagagaaaataagttttagtgcctgaatcacatatgttgctattaaatgggtgaataaatgaaagaaagacacattttcatcaaagacaaataataatacagtcagttgatgcaaagtagtactaatggatggtgcatataaggaaggcagcagggcaccaaacgtgttaggggtcactgtgagctggcgtcctgaggagggtgttaccttggaaagggagatcatgtcccaggagggcaatagcttgagccaaggtaaaagacaaggctgtgtaaatagaaggatgcaaatttcaaagtggctaatgtcctgtgcctttttattctcattctccaaccacgtagggagcccctactctgcccagcactgtgcttggccttacagctactcagatgagcaagatacagtccctgcccttaagaatctcaaggtcctttgggaggctgagacgagcagatcacgaggtcaggagatcgagaccgtcctggctaacacggtgaaaccctgtctctactaaaaataaaaataaaataaaataaaataaattagccgggcatggtggcaggctcctgtagtcccagctactcaggagattaaggcaggaaaatggcatgaacccaggaggcgaagcttgcagtgagccgagattggggcactgcactccagcctgggcgacagagcaagactctgtctcaaaaaaaaaaaaaagatctcaaggtctaggagggaaaacagactagcaggcagatgattccagaagagggtgctaatagctgcagtggagcaaggcacaggttattatggaagaacagagggaagggatccaactgaccctcacagcacaggagcagaagggggaagaaagagggcttccctcaacaggggaataatagtaacaagacatcaataacagcacaataacttcagttgagaactcattacatatcagggactatgtaccctatgcatttctttgcttctaactacactacacacacacatgcacacacacaagcgcacatttaactattattatcttcattttcctgattatgataggacacagaatcagagtggttaagtaacctgggagaggtcacacagtaaccaagagagcctggatatggacaactagattgcagaagcagtgctctcaatctctctacgacccagcctctgaaaatcatgaatatttcaaatcatatctccttttagcaatatataacagaaaccaaaacctctccttggcgttgctattgtacacgtgttgacagcagagtcttcgaggcctttatcggaatgcactgcagcaatgacacagatggaaattcaccatcctctgagttttcttgggttcttcccattcagcaaaaggggatagcttatttaggggagcactggccatgatgacctgaatgaggctggaaagtgacttgcactttgcctgaggctgcatgttataaggagacaattccctttctaatgcttccccattgttactcaggaaatagtcctcatcacctgactccctatctagggggattcccacttcttataaaatataccgaaaggaaataagaaaggccaaattttgatgggcttatttattgatgagagcgctgtttttgccttggattcattcatgcgcagtgggaagaagtattcaaatgacaagagttaaattcaaaacatgtagccgctttctgttacattttttttctaactgaaggcaaaccatttagatgtttgtttccaaaaaggcatctgtcagcaatcaaaggggaaaaatgcataaagcaaatgcaattgtttggagtagcatttcctggatcatgttaaatgcttgaattgctccccattatgctcaccaaataattttatttcccacaataattgcaatatttaacatgttttatttaatcttttttaaaggctattaacaaagggccacactgtgaaaagattgattgctgcatgggaaggacagcttccaccagcctcttagagaacaatgataaagttaaatgcacctaattgttctggatttaaaatactattatccaataatatttatcatttttttgttcaaactatgtgccctctcctgcaaaatcttcccggctattctatcattcacagagtgaaatctggactccagtttaccttgtgctccattcattcataaataatgggcatgcatagggtgttctgagtctcaaaaatgcagcgactcagacaagaaacagctccaacttcagaggttgctgcaggataaactcagaaactgtaaagctgtggacccacaagtccaagatgtccatgtgcctgtataccctgggagaaagcagaggagaccctaaaacagggaaattttgttttgtctgcttgtcagaggcaagtaggaatggatgaagtagaatcagaggttggttgattcaaagacagaatgctacttcatttcttttcttcttctttttttttttcctcctttttttgtttggttgatgatattttacattttatgtagaatttccaacttttttccttatctttctctaaatgataaacttaagaaagactaagtaattttaatgatgctgcagttacatatggcaataaatgttttcattggcaagctcagggcaagtttctggtagtatgtccattgtattcattggacacaagctaacaacatttcctgtgctactgcagactcttcttctgaaaagacaggtgacaccaaggtaataaagtatacaaagatacttcctaagagtgatgacaatatttacatttgataataattctggctatcgcctctcaccccaattttattagaagaaatcccattacaataaggaatgaaaaagaaaaaaaatgccatatttgttgtatttgtagttcattcctagaagcagtctgtgcatcatgctttaagttagaaatatttttggtgcaacacgataaaatttgctttaatacagttatttttgtcaaaacagcatgctaaatggttaaaataatacctactaaggaagagatcagaaataggaaagaaaaatgcaccaaatttacctctttggaacttaaaatatgctctgaatgagtttatctaaatattattcagtccaaaatatgaccagaaccaaaaatccactggataattaggcagtaaatgcacaactttttaaataatcacagttcaacagccctgagaaatagtgatggacaattctcccatattctggagtacatatattgaaggcccatagcggagaaaactgtaggttcttggagatcaaaggatcgcttatattcagaaaaaattaggatgtgtttggtgcacatccacgaaaattaggacgtgtttggtaccctgataaaggtatttctacagttcctagtgtcacacaatttgaaagaatataacgaatacaagtcattctctctgcttctttctccctcttagtcctaagtaacattacttgaaatgcagcaactgtctggactttttctcactttaaaaaaaattatttttacaaccattcttattggtaggtccatattgtggtttacttttccatactaaagagaggatgtgtggttaaaaacccctgtgaagaagatggctaggttatagtaaggaaatcagaagtgactttctctgattaaggaagagctcatgtcaagtttagcctgaattgtgctaaaccgaattgataatgactgattgctttgtttacaaagaatggaaaagtccaaaattaatgtatttaaaaagacaccaaaaaacatcggtggtgcctagcccagcataggttagaacttgtaaaatatcagtaatgtatttatttactcacataaatcatacatctaaacacaatgccagccaaaccaaaaatcaagagacttgaatgctgccatctcttgtttatcttccttcatgactaaattaactaatgagttaattttcaaaaaataaagtaaggaaagagaaatattttttcctggaaattttttttttaactccttggaaaacctgttcagttgttcccagatttagtttgagacttttccaacagagatgtgtaagacagcaaaactgaactaaacatttttgtaaatgcacggctcacgttcttgagaaaagtggctgtgaaaaacagatactgaatcagacttaaagtcaaagaagggggggtgaataggggggaaaaagcccaaaacattgcatgatagtctctaagcagttccatctgtcaagcagaaattttaggctaatagcctgtggcgatctccctccgcagtccactacctgcctttgtcctattaaatctctttattctccttaaaaaaaaaaaaaaaaaaaagagggggggattggttattggaaggaaaggaaaaaccccgcagaccaaaatcatctgagtgatgaagccctaattttaactacctccctttgatgtgtagcagtgggctcttgtttttttaaaaaggagagaggagaagacagtgctaggagcagaagacttttcatctccacttcaccttgccactgggtctgtgagagattggttcattgtcaaggagatttttttttttacccatgattccatatggtatggaccggactacatgttgccccacatgccactgcaaatgttttctcaattaggtgtcttatctcccgtgagttagcatcagatgaagcttgctgacagcgtaatggcagggaaagcttccgacggctccatcaaatggcagctctgctacgacatctcggccagaacttggtggatggtgagttggcagccggggctgctttttttttttttttttttttccttttctactttccctccctctttgacaaaatgtcccagacctcacattcatcaaactcacatttgatttttttcacactattcagtgaggcagcctcacactgctgcctcttgccatcctctctctgccactctgcgacttgagttcccaggaatgcttgccctcattttccatgggacagtatttggggttttctatttttttttaattcttttttaaagagtatcagttgtaaggtggaggtggatattttagccaagtcagtattgggggaaaaagtgaaacattcgtcccagccctcaggttttgccccctctctccagtttcacatcccccttacttttgttttcagggactatggggtgtatggttttctctggctgtggcattttctgaggacgcgtgttgggcactagggagaagcaacctctgagtgaattctagtcctggccaattaactggattgcctaaagtcacctgtgagagaactctgggtccccactccctattttccatcagggtcccacagctctcatctaacttttctccgtttatgtcagagcaggttttctgtctcttaggcactctagctctgagtggaaaagacccacacactctatcttttagttactctggatataaataaagtttgaataaagttctgccatgcagcagcagaatgagttaactcacatgtcatggtcaaccaggacagacaacctttgacattttggatctataagaggtagagtgagttgtgaggatgcacaatagctcattgtcacaggagatgcaagtcccgtgaggaagagagtcctcaaatcattactgccctcgttagggtggtgtccgttaaggattaatttgttagcagtgcatttctagttttccgtaattattattcttgcggcaagcgtgaattcttccagggagtgaaaaaaaagtttgctgccaggacaatgaatgtattatccgttcctaactggaccgtgaacttcagctcatttcacatagatatcagtttaagaaaaaaacagagagagagagagagagagagagatgttgaagggggagactggcgaatggaattacaaaacagggcatggtcggtttcactgtatgatctgcagaaagagttctcttttccccttcctggaccaatggtggtatcattttggcaagttttaggaattcggaggactgagagactgttaaaagtgagctaccgcaggattctatccggctgcttcttgggatgcagtatgtccatcctaaggactgttgagttaaagtggttgtgggtatgtgtgtacatgtgtgttttaacttgtaatttcttaactagacattagaaactttaccagtaatttcaggacaatgttgcatgcagcttttggctaattagactaacagtagactatccactttgaccctgaacttttgttcagggcacttattttcccattagagttcttgccagcaagaacaaggtttacttgtgtatgctatgatgttacctattgcttcactttatacagcttgttaaacattagaaatgaatatactgattggtttagcaatgattttctaagttgtaagctttttttgaaaaaactgcacgctgatgtcatattctgggtgaaacattttacttccttgtatttcaacagctcatagattttatagactgttactttttatggcaaattgtgtcatctctctcttttttttttcttgcaaagatcaccaaatgcttctctttttttaacttggaaaactgtaatttcttttttgtaaagtttacttggaagttgcttttcatttaaaattattttacagatgttttaccgccgggaatataacatataaaagtggtggaaacatttagcaatgcagttgcctaaaaataaacaatgttgaaagctcacatgctgctgtttaggctgcacactacagggaagtttctctcaacttcagtgcttctagatctttgctttgaaaaggagtgagaaatcagagcgctctctaaagaagttatacaagttatcatagggaataaatcaatttgtttctttccctcaaaggtgaccacataccatggcatttcagatctgtcagttaccaataattctaatgtaaatttcccattattgatgggaaattgaggactttgatgaaggaggagggaactaattaaaataatacaaatttcacattttctcttagatctctttccttgaataacatgctctccctctccctccattcacccacctcgctatcccaaacaatttccccagctgaaagaaaaatttaaacttccctctggctgatatagttatttaatcaaaggacagtacaagatcggagtttcacactaaaggcaaataaagctttaaaattacctcatgcgtcatctggctgcacagactccgggctcatagtgggaacctccggcttggtcctcccagcatacaaaggcaactcagtgaatgccccctccgcccgtggagacgcggcctcagctgccagcgacgggatatgcaattttgctttttaatgaatcgtaaacaatttgtatggcaaatgagtttgtttgttttagtttgggggcatatgttgtaccaggttgtagacagtcattacctactccagaattttaggtgagaatgagtagagctctggatcatttttatttttctaaataataaagacacactaggatgaaagaaactggttaataaaagactgagaataacaacctctcttctccttccctctctcccctcttttcctctctatccccaccccctctcataactcactcaggcttacagtagggctttagctacactttttgataactaactggaaataatcggttgactcgattaatttttaatttttttaggtataaattttaactttgtctttaaaagactacttttgtttaagaaacagttattttaaaatatgtaatatggagaagggccatctctgtcctccattactttttttggttgaagctaaggttgccttgagggacatggatataagaatgataaatacatgttttatatcaaaatgaagcaagaaaggggtcttgatattgaaaagtcaaataaaaaagtttattcaaacccacagagttgtaaacaacttagaagttaacaagcaaccagggttcaagcatgtacattttaacagtaattacctttggcgctgccacttatgagaaaccttttgatatctgagccacttctctaatgctttaatcatgcaaatcaagaaatagatattacatatcaacttaatctagctgtgttgtgacatcgctagcagaaactctcccatagaaaactaaagaaaaccctcatgaaattttcctcagctccaaatgaaatggaggcaccctagaagcatgtatttgcttcaaaatataattctgtccagcagaattatctccattctacccatatggcatgaaatgaaggcagaatgaacattctcctcttcataatgataacaatgtgttatggaactatttttatgtgaattacaaaatgcacttgtcttgcttctgccctccaatttaaaaactcatagtgactgtgaaatgaaggcaactaaattatcctacagccccctcaccccatgctaggtcctgaagcacttattttgggagcattctctttcaaaaatttgacatacagttttaaaatcaagaactgtctgtcacttactcaaacttgtacaactcaaactttgcataccaggaaaacacttgggcaaaaagaatatgctgtgccttgtggtacaaatgcctactttttaaagtacacatgtaaaaaatagcaagatacttctatgaaatactgccttactatgttcaacaattcaaaaaaaaaaaaaactcaactccagcctacttcccaaatgattggcagctttaaccactgcagacacaaaattaagaacacatatttcacggaaatctttgttgttgttaagatgtgttggattcacatattacgttgtatttaccatttcaattttcaaaattctcagctgaacaactcttcttaatgattgtttgttataattatttgaagatattgcctaatggagatttgtctataaatttgcacttatgcttttatgataaactaggaaattgctaaaatatctataaataaaaagactcaaaatgaggagattcaataaattataaaccatatcatattctcagcactcagcatatttttaaagagtccatggtaaacatatttatacactttctatttaatgcatttgcaaactctatttttaagtattttcacagatattttgcagatatttgcagtgcagtggctctacctgagcttatttttaaatgcacaatttttatcgaccattataaatatatgtaagtatattaatttctaagaatatgcattaacttacaagatttctgtacactccaacattattttctcacagtataagcagactgcaagcaaaatctgaatgggataggttttttttccctctcacatatattaagaagttatccttatcattttcttttaggttagccttgtacaacatcttttaaagtaccatttactatttttagggatacattgaactatgttcctatttttttttctttaaatcaaattacgatccaaatgtacttcattcagaattgtgattggttacttaagcaagcctatgtacttctactatctttttaaaaatcttgatttcctgttgttatactcatatttcccctgtgaactttagacagtgaaataaatgctttgtccttacttattttctagttgattttccttcacctgtactgaatattgacaggaatgtttctaatttaaaaccaaaagagtcaggggctgattagaagacaggaaattggaggattaaactgtctggttgcacttcctttacttatcagcactcagtaactcactctagattacaaactcaacaggacaatttttacaatgcattgtttcttctggatgtttacatatatacagtgcatgtgagggtgtgcgtgtgtgtgtgtacacgcgcaaccaggcatgcacatgtatctgtatgtgtctgcatgtgcattcatgagtaggaacagaaaagaaccagcagctggtagttataagtagacgcttttaagtgggatagttttaaaccaaaggggcttatactatgggtatgaaagttcattcaaagactgtaatcccaggatactctcaaaactttcttaccaaaacagttctgtgaaaccaagcaaacaatgaaatactgtaagggagaaagcaagacgcactattttgaaaatgaaaaatagattgcagtagccctaatgcagtccattttcctcaaattccaaacacccatattagtgaatgaatagagaagggtacccataaggagtgagggtgttaatctaacaggcattcaaaaccattttgagatccctttggcaccaactgagaaaggaatctttctaactgtggcagcaggtctgaatgttccaggtgagcatatatgatgaaatgggtgcttagcagggaatgaaatagcagatcaggacaagagggtaaggattcatcttatgccatcagatcatttaaaattaaaaataaattacgaaaacaaaacactgttctagatttttactgtgtcgtatatctttgcagagccgtgctctggaaaccatgctgagaattatcattcctgacctcactctgctcacctctgttgccctcaataagtatttgttgatttggcttaagagagttctagatgaatatgtgaccatttttcctgcttctaattgcaatggtgggttctactgagagatatagaagatgaagaggagtgtgtgatctggcaaaatgagctggttgcttagactggtagagctgggagttaacatttaggggcttgttctggtagccctttattccttcacctattcaccaaatatgtattaggcccctactaagggccagagggggtgaaaatcagtggctgcttctgccagctgccatcattcaagttttaaaaacactagggaatccctccgcacctaatgaataacattgattgataactatctgtgagaatctgtgctaggggctttacatttttttttatttttcatttaatcttcaccacaaacctatgaagtaagcattattgtcccgctttatatatacaagaaccaagactaagaaaacattgcccactgcccaaggatatgcccaggccgaggataggccacccagactatagagtccacttgcttaatcttagaccaaatttgtctgaagttaattcattattttagcactagaatgtaatgttattcagaacttcacagaagtaggatcatcccttcgtaggatggtattcaaggggcacaagtctgtttgctaagataatagaggcagaaaaaatgtatattgtgtcaaaagcaagaataggacacaagtcttgtggtgcctggtccctgttccagaagcattgtccatgtttctgttctgaagcagaaaagctagtctcatcaccaacaaaagaaattcattagacagatgagagagtctgatgcaaagaatgcacctaggcatattaaaatgcaccttttcatcagaaggtgcatgcacgggtcagggaaacccagtgtgtctaagttcttgccaaatattgagaacttttttttctgttagtaatttaatctttatttagcaaatatttcacttacagttttaaatggagcattccattaaagaaaaaaaaaaaaagaggccatccttccaaagaaaagttccaggttttggctctctgtctcccttttttataataagcagaaatgccaacatataacagtattggtgttgaatactttttgttgccacagaattgctaattaaaggtttgtcccaatgtagagttttctgtaggagaagacacaacccaggatatatattgcctaatggcaaagatcttaatacacgcattacaagtaaacatctattttccagacaactgctgactataaacagtgtgtctcagccagagctttttaatagtgccacatgtgggacagatttcttattcctcctaacccaagttccttttgtgatccttgatgtgcacatgctattgccctgctgactattttaaatggatgataattgggaataatgaccgggtcagaggtagggatgcgtaaaccctggcagagcagccttccaccaagtcaaagcacatggggccctcagagccgggagccggcacttgtaagctgaattgagcacacaatgtatgtggctggccacatacgttgccaaataaatatcacattacacatcccatctcccccacgtgaccttggtgtagacaaagtctaaactcatctaggagatgagaacatttttgttccgagaatgatcccatctgcctcccccaactcccaaatatccttcaacccctctccttcacagatgtgtgcttttcagtcctgcggaggaaatgccttagcggctgggtttgataagccctcttcaaatgttgaaaagacaaacagtgtcggctaaataattgatttcatctattcatttaagaatcaattacagtcatcccaccttatccaaggaggatacattccaagacccctcgcggatgcctgaaatcacagatagtacagaatcctatgtatactatttttttctacacatacatacctatgataaagtttaatttagaaattggggctagtaagggattaacaataactaataatagaacaattataacactatactataaaaaaagggtatgtgaacatgctcgcttgctcactcagaatatcttattggactggactcacctatttgcagactgaggttgacctcaggtaactgaagctgcagaaagtgaaaccacatttgacggtggactcctgtaaaattatcacatattgtttcgttgtgtctcactttaagaaaaatggcggccgggcgcgatggctcacgcctgtaatcccagcacttggggaggccgaggcgggcggatcacgaggtcaggagttacacaccagcctgagaaacatggtgaaaccccgtctctactaaaaacacaaaaattagcccagcgtggtggcgggcgcctgtaatcccagctactcggaaggctgaggcaggagaatcgcttgaaactagaaggcggaggttgcagtgagctgagatagtgccactgcaccccagcctgggagaaagagcgaaactccatctcaaaaagaaaaaaagaaaaatggcaacttcagttctcgtttttgtaagtatgcgagaaacgccctgttatcaggtgtcatagcctgaactccgtcctaataaacagtaaggaatctttgcatgcttgtaatacattgcccaatactgaggtccaagtcaatacagtattgttggcagaactgcataagaaaaaaaaagataaataattgacctaggggggaataactataggaggggttgatataatttctcaatgaaaagtcaagaaataacaaagctaaaaatggggagcacaaatgcacacgtcttcagaccaggcaggtcagctaagtggaagaggcagtggggctgtgataagtacacacaggggtgtgtagggcggggtggggtctgtgacaaactggaaagtgatttaccacaaacaacaacagtgaatacaacactgtactaaccaaacagaatgcatctgctgcctggggcctaaagctattgtgcatacaccatggatcagaagatagaatgaggttctggcatcaaagtgttttattctacaagaggaaagaaacttaaacgttacatgggaaagggattacagcaatgtaacccacataaattactacactacaggttaaaccattcacgtctgatcttttcttcctggcagacttttgtgggtgggagaagagaggcagaggaccatgtcagtatctaaaataggaaaaggggccctggcgcaggaaagacacttggcagactagagatgttgggagatgttggaggattcataggggatgcagaaaaagaagcctggtgatgatagagaccagcagagccttacctgcccactccatttccctctactctggccccagatttttcatccatggatttggaatccgtagggtctcatggactatgagttccaggaaaagattcttccctagcactcaggctgatgctcatgcccattttctccacccaacaaactgtacccttcctgccaggctacatacaaatgaaggcttctccctgaagccttctcaggtcccttcaggcaaaatgagtcacttccccgccccctccctctggcctcacagctgcttgctcatagtactatgacagtgattaaattgtgttggagtttttctctttactatccaaccccactacattgcttgttgcttaagaataaagactagggtcctacacgtcatatctccagtgcctagcctttggcaagtatcacctccctacccgcccacaccaccccaccccaccccccaaaaacaaaacagtgtagttcagtaggaggtgaagttggggaagtgagggcaagaagggctagtgggtcttccaggactctgcttcccccagagcaggagcctcaagactacaagaggtagactatccagcaaactgctgcctgccatgtgttgatggagatttgtgatgcctgtgtgttgactgcttgctctgtgtaggcactgagcccagcaagtgctctacacacatgggagcttttctcaaaacatccctttgacgtcaatatcattgtttccactccaccaatgaggaaactgagtcatagggctgaagaagccagtaaatagtctgagaacccccaaagctaagttctcctatgctgtgataatgctaataggtccagcactgtcatgctctaaggctcaaaaaaagactgtgataattaaatgcgggcaacatttcacatcattttgtaaaggagaagactggagccctaaaggctaaaattcttccaaagtcgaagtattgacaaaattttgggtctggaattgaggcctctagtgagcttcctgctaaatacccatggtagagaatcatagtgtatgctattatttaactaaaaccaagcaagcattttctccttctcttcagttataggttaacatgagattttcattttttttttcttttggcttttctgtatcttttaatttttcttcaatgaacatgtattttttacttataaaataacatttaacaaaatcatactcactaaagatattagtccgtttctcactgatctcgtaagaatggcagtagcagatgtcataagactggtctttgaggatgtacatatattcaaagtagaatggtgcccatttttttcattaaagtccatactcaatggctcaattattgtttttaagactttatttatttatttatttatttatttattttgagacagggtctcactccgtcaccagggtggggcgggaatgcagtggcacaatcacagctcactgcaacctctacttcccgggctcaggagatcctcccacctcagcctctctgagtagctgggactacaggtacgcaccaccacccccagctaattttttgtatgttttgtagacatggagtttcgccatgttgcccaggctgatcttgaactccggggctccagcagtccccctccttgagccccccaaagtgctgacactacaagcgtgagtcaccactcctggccaagactcctatttctatagtgggtcaggtagttcttcctatttcccatttcccagtgtagcagctgtcagaagcaccaatttctgattaagcacactggtcaaatcctggctctgccgtggatgtgctgtatataaccatgggatggacagtgacattctgaatctgtttgtgtcttcaaattggaaataaaataatcatagtgcattaggaggattagatgaaacaatgcatattgcatagtccagaaatctgggaagaattctcacaccttcctcttgcttacccaacatctaatcccaaataaatcctgataaatttacctcttaggtaattcctaaatccatccactctccccatctcctccactcttcccccatctaagctactctctgtctagcccacattaccatagtagcttcctaactggtctcatggcatccttgccctccacaatttattctttacacttaaggctaaaagatctttccagacacacgtaatcatcatttcaatggattactcttcctcctagataaagagcaaaatccttaatgagacctgcgtagttttgcctttccaagcctgtcttgagtcattcttcttctccctaaacatactctagccagttaatcttctgtgagttcctcaaaacccccaaaatctcaaatcttacccatattaatctgctttccctagaaacattcctctctttgtagttaacacttctacaccattcccaatatgaatgtggccttttcatgaaaacttccctatccccagactttatcaaaggacactactgataaactctcagaacattccagatgttcctttatataaacaaatagagctgttatgcttataaatatgtgtgactattgggttactttatgtttctcccaaaataatataagctccacgaaagacaatgtcttactcatacatgttttcttgcatccaggacagaacctgggtggtaagtaaatattcattgattgaataagcacatagacagtagagtggctgccatagtgaacaccgagatattattaaccattgttgtcataattaatatttgccacaaacagaaaggtgttttaatgtggataaagtccccttttatgtctttaaagaaaatccatttctctctagtaaaacagaaattagagactaaagagctgagagccccaccccgggtttgggacctggctctgtcatgtgctaggaatggacttcagccatgtgatttcacgtctatgactgtggagcgttatatgagttaatgccactgatgtgattagcatggtatttcgcacacggtaaacatttaataaatgctttattattactttcaatattataaatggtcccaaatcttcttccagtaatctgtatggcctttaaaaagccccttaagctttctggttgtcagttttgtcatctttaaaataatagtgtcatttttcctatggttcatgaggctgtttcaaagatcaaatgaatcaacagggagaaaaagcctctctgaaaattaaaaaagtgggatccaaatagaagaggctactattgctaagcctaaaaacacaggctgcaaatagacacattctaccaaaatcctcatggccttttctttttctttttttttttttttagatagagtctagctctatctccctgactggagcgtagtggcgcgatctctgctcactgcaagctccacctcccaagttcacaccgttctcctgcctcagcttcctgagtagctggaactacaggcacctgccaccacgcccagctaatttattgtatttttagtagagacggggtttcaccatgttagtcaggatggtctcgatctcctgacctcgtgatctgcccgccttggcctcccaaagtgctgggattataggcatgagccaccgtgcccagccctcatggccatttctttatcttctcttcaccatgggccatatgggggaaaggagaagtagttcaacacacctagtcaacaatgacttcaagtattgatcattgaagggatgtgcatgtgtttgtaaggggaagaagagtgagaaattaataaagagagtttagtttaagagcacacactctggaatgagaatgcacattttgaattccttctccacaactcacaggcaatgtgacctcaggcaaattgcttaatctactcacctgtaagttggacaaatgctagtacctgcctcatgggttgttgtaaggattaaattatccgtataagtcactgagaatattgcctaacacatgtcatactcttaataaagatcagctattaagattgtaatcattttcatcattatcatcattattattttggtaactatagtgttttaagagattaatattcaggggcctagaaagttagcaagctggggccgggcatggtggctcacacctgtaatcccagcactttgggaggccaaggcgggcgtatcacctgaggtcaggagttcgagaccagcctgactaacatggtgaaacccgtctccactgaaaatacaaaaaaaaattagccgggtgtagtggtgggtgcctgtaatcccagctacttgggaggctgaggcaggacaatcacttaaaccccagaggcagaggttgcagtgagccgagaccatgccattgcactccaacctgggcaacagagcaagacactgtctcaaaaaaaaaaaaaaaaaaaaagttagcaaggtggttaaagaatatctaacaaacatttttactcaagatggtatatttggattttgaagcaaagaaatcactttcccactgtgttagattaatcggccccaacaactgaatttgcctaacacaagtgccatgtgtctaagacatcttctctgtaacagaaaatttacgaaaaacatccaactaacaataaattatcccacactgtagaaattctgcatttatgataaaaacttcatccaagcagatgtggtcccttctcaaggtacaattctacttcccaagatgattactcagtgagagaggcctatagaaaacttcctgtgtcacttaaattcatgcagagctacaagcatgcttttgctacttggaattgtcacaggttcagctcaacaacctttagtcaacagtttttttggaatatccacgaccttttgttccctcgggagatagaatcaaaatgcatctattaatcttgagtttattttatttcattattcaagaaaactatgttaggaaactttaagaatgtgttcaataataatattaaaaataatagtaatagattgcatatattgaacacatccatgggctaggatctctactgactatttcacttgtcttacatcatttttctcccacaatagccctatgaagtattcacattttatagattagcagccaagatgttaagtaaccctacctaaggttgattcaaaaatctagtaggtgacaggtataggacttgaaccttggcccaaaactcatactctaaaatttatagcctgaaccacctggatatactaactaatttaatatgttgttatattaatgtttgttgtttaaaatttacattagttattaatcatatcattaatagttttgcacatggagaataataaccacaaagttgtcatggggatccaggacttaaggttgcagaactaaagacctggaaagtgtaataattaagcccctttagcccctctcaatgctaagtcagttaaaagaattggagacctctggtttgaacgggcttctagctaggaggccctaatggaacctttccaaccttgtaatacttaagacatgaaagaagacaggacatctttaaaatgctgacaactggtaccaaaaatggactcactgacaattctggtaggaattgtcactaactacatgtctgtgatattgaatagaaacatacaattagtggcccatgactgctatgctgcaaaaataaaataaaaggcccatgtgctcacagaaatagataggagatttttggtggtatctacactgtctgtctgctaattcaaaaacacagattctaaaacacatagagatagccattcctgttttgccactaacatttctgcactcattcagataacgtaactaccacaaaacaattaagtaagggtggcagggaagccagcagtgacacgctgcatcatctgaagtgtggtcccactagtaaaacccaaaagacagtcaagaaatggagaaagtcctagtatacatgcatgctgggaattataattgtatatattccatctgctctgactgttagggagtcaagcactgggttacaaaaaaattcttaacacagacaagcagaatagcagaaaggtcctactacactggaaatcagaccagaagatcaatcttatgtacagctataaatctgggaagaggattcaccagaccccaaatggagagtggatggattaccaggaacaatctacatacccaaatgtaagtaaatactaagtccagataattctctccacatctgaaaatggataaaaattttgtatttttccactgcaaaaatgaaaagtgttacatgctgctgaagaaaagcaaagggtgactcagaatgaaaatatctgaaaatcgttaagtataaaaactgtaagaaacagatttaaaatttctgttctttaaaacaagagtcaaaagccattagaagaaaataagaaataaaaactagggggtagaattttaaatgagagtgacaaactagcaatgcaagaaaactaataatgcattagcagtattaagactgctatggagcagaattaaccctgtgaaaattgatcagtaatttgaaagtcatacttccaataactttcccagacacagacaaattacccaaagcataaaacacacatgaaagagaatgacacctatcccagaaagtgaagatccaactcaagaattacaagggtgtttccaaagaaaaccagaacaattgaataggaaacaacaatcaaagacataacagaaggaaaaaaaactttctgaactagaagagggtaaaaaaggatgcacatgcaaaacattaatagacttagccaagtttactttattccaggccaaaataaatgagcaatccacacctgaactcagcctgctttccagaaacagaaaaaagaattgcttacaaaatggactaggaaggggagtaaaatttcactgtcttatctcacatagaagagattctaaaattatatttaattgttgaatctgataattagaaaaattaagatcaaaaactgacttctggaaaactaaagtgaagttgaaaagaggatataaaccttcccaattactaaggaagttaaaaacacacagggcattccatatatcaaactcctaaagcaaaatagaaaagaaagaaagaaaaagaaagaaagaaagaaagaaagaaagaaagaaagaaagaaagaaagaaagaaagaaagaaagaaaggaaggaaggaagaaagaaagaaaaagaaagaaagaaaggaagaaagaaaaaaagaaaaccatgtagaacagaacaacagaagttaacaaagcaacccatctgacagtaaatacagatggcttaaatcccctttattaggaaacaaaagttctcaaactggagtaaaaaattaaatccaaatatctgctgcgttcagtaggcatatctaaaacaaaagtgttcacattaaaaataaaaagaatggcaaagaggtattgaaaacaataaaatgaaaaatagaagtgataatttctggcaaagcaggcttcaaagcaaaagcaattaaataagagcaaatagattatgtgtatatcatctactatttatattacttatgttgataaattggaaaatgagataatgaagttacagtagtaattagtctcttcatgcaccaactaacctaatatcaaatgatataaatttaaaactattagaaaagcagagagaaactgacaagaccacaactggtttgcatgtaattttaacacagatttatttaattttgatagttttcattaggcaagaaataatgacatggacaatttgagtaaatataattaatactattaaggctcctagaaaatgttggcctctataaacagagaatatggcaccttgaaaagtatttttaaaaccttaaccaaaaatttactgtgttatgcagatgtgtggacatacacacacacacacacacacacacacacacaccccaatatattccaaaagtgaaaattgcacaggctttcttgtctagtcatatgcaataaagctaggaagtaacagagaattgtcaacatcatacttaatgacaaaacaagaattattgccattaaaagcaataacaatgtaaggatgcccacaatcacccttactattttttctttttctttctcatttttttttcctttttttttttttttttttttttgtcgttgagatggagtctcactctgttgcccaggctggactgcagaggcacaatctcagttcacagcaacctctgccacccaggttcaagcaattctcctgcctcagcctcccaagtagctgggactacaaccatgtaccaccatgcccagataatttttgtattttttgtagaggtggggttttgccatattagccatgctggtctcaaactcctgacctcaagtgatctgcctgccttggcctcccaaagcactgggattacatgcgtgagacacaacacccggccacagtcaccattactatttaatgttgaagaaattctgaccatctccaatgatatgaaacagaaatacaggtgtaattattaaggaagactaaagaattattattttcagatgacctgattaaatacttagaaaatccaaaagcaccagttgaaattaataagatagagtactaaaatgatagccacaagctaattatagaaaacaatggcagttaaaaaacatatggaaaaatgactccactcccagtagtaacaaaaacaaaattataaaatacctagaagtaaccccaagaagaaatatgtgcaacttaaatgaataaactataagtcattactaagaagagttgattaaacatatctccagtgtggggatataacatactatatcctaaatgtttcaaatgtaacaattttccctcaaattgacttatacttccaatgacattcatgtcaaaatcctgaagtattaggtttgtctgtttgttgctttgctggagcttgctggaatttacatagcagaaaataaacattttaagttcaaaattatatataaatgtaagagacaactcttaaaattctcaaaaggagggcacactctgtgcttggaaagagttaattctgaataactttaatattatgtatagaccttttgcctttcctgagccaaattgttgccttagatttatcctctgggcacttgtcaatagctacaaaaatatctcagccaattagcatttctaggcaagagctactctacttgattttattttctagttaactgaaagttaacccaaaaacaacagcatacttttctgcctcaacaaggaattaagtttgaatctttatttaatgcataaggatttgcagagttcagagtcaggtttctgagcatcaatttgtgactatatataatgttcaatttagaaataggaggaaattcacagttattgaacactatactgtgtgtcaggcacttgcttgatgttgtcaaacacactgatctgcaccctttcaagtgttaagtattgttatctccattttccagacaaaagaactgagattcaaagagttaataaatctccccatatcataaaactactccaagatggtcccaaatcccatggtctttctttaaaactaagctagagacaaatctcctaaaagtggttctagaacagggcattataagcacacctaggagttggagatccccctccacacatgcccatagcccacagactctgatacgccatccaagatggggtggggtggcaagcagatatgctttgaagtgtcttcccagttaattttgatacagcaagtaacatttttgagaaaaactgatttcattttctatacttatggttgcctattttcctattacagtaattagaaagcaagggaaatatacacatttctacttaatttcattcagaggccagggacgggggctcacgcctgtaatctcagcactttgagaagttgaagcaggaggatcacttgagcccaggagttcgagaccagcctgggcaacatagcaagacctcttttctccaaactaaaacaaaaattagctgagcatggtggcatgcgtctgtagtcttggctacttgggaggctgaggtgggaagatcacttgagtccaggagtttaaggttacagtgagctatgattgtgccaccgcattctagcttgagtgacagagtgagaccctgtctctaaaaaagtaaaatagaaaaacaaaaaaattcgttcagaataataaaggaattttgtttattttgcttttgaatgaattcttttactactacaggctgtgtggattaaatgaggtctgccatgagacaaattaaaatgaaattcaccaatatgaatttaagcttacaacaatatctataaaagctcattaagagatgcataatctctcatctactcaaattgttgatcaaactcctctccaccctcattgtgctataccttctgtgctgtactacagtggtggactgagtgatccttcatgtgtgagtgtgtgagtgcctgtgactttggtattagtgagggctacagatctggttactgccacatcactgtcttttttgaatgctgtctgttctctccctttgccatcatctgcaagagcataagaatggtgtcatacttctcttgtggatcagggttctgaggaactgaagttgccccaaacctctgctcttgaaaatgagggcaatgacttatttgacctattgcttgcctagctctttccctttagtccaccattttgccttgatcacattattttctcaatgatcccacataggtggggtaggtagttacctatgctctaaataggtgcagagtctcaattctttctataacaagctatcacatggctaaaatgccacctgtgggcacagcatgtcctttcccttatgagtgaatcagtttactagatcagttcttagatcccagtggagtgtcaggatagcctgagcaaatgtgaatgtttgggttggttcacccaccctgcacccaccaaggaaggagagagaaggccaaaagaaagaagcagaagcaattggaaatcagaggcataaaggtctaaagacaaatatcatccacttctgctttcaaaaactcactattgattctactatctcacctctaaaaacttgaaatatcacagaatatttgttcttgtcttcagtccctggtaaatgtgcacagataagcagctatcatttttcaaatctggagcatactaactctggttacttttatttcacctaatcttcacttgaatttttcctcctgggcttccccctgtaacttcgtaagacagcacttattggatgtgccacagtaagagttgttttctgcctttggagttaacatcaacattagtcacatgtccccaaaccaatgtgagagttttgttacctccagcaaccatctccaaagaacacagaggaatggcacggtattttctataagtcccccgaatcatttccagaataattccagttatttatgaagcatctttgtttggatgcaaatataccatttaaaaacctctatgagtagagacagtgctgatctttgttacgttaagccagattttccaaaagtatattctgcagaaccctaattcctaatcacctggagaaaataaagtttccatggtgaaatagattaggaatgtgctaaatcagctaaatgtgctaaagttaaacttatttattgactgctgaatatcagtgtctttagcatgctattacattttgtgactctccaagaacaattttataataagcaacatttctcaatcttgtgtaactttgggccagttactttattttttataagcctcaatttcagtctcctcatcttcaaaattaagtgtttagactggattgtttcagcattaccttccatgtaccatccctaagagtctatgacaacttttcattaaaacaaaggtttctcctggagatactacctatcacttttctctactatctaacaaaaaccctttctcagctatgttactgtggacatcaggacaggatgaagactgtctactggggaaacttcagaaagaaacttcataatcatttccaaccggatgaaaaaaagaaagagagaaagaaggactgcttgggactattattaattgtgataacaacagtaaaaactgtactcccctttgtttttttccatccttaccagtttcagcattgatctttatctgaaattacaaacatttctatgacaatttgcttccatccagaacatctggtatctggccagaaactgtaaattgatgctacccgctctagtgtctgacttgagaaaggggctgggagggggatggtaggagcagaggaactgtggagacagacgctgctgagacatttaaaatgcactctcccctaataggaaacagagcagactgtgatagagagaagggaaggagagaagcagctcactgcaaatgggggcaggggagggaggaggagtgccttgctaccaaaggcccagcacccggcagggaggcctggaaggatgcaacaggagcggggttgcctgataagacagcgatagaaaaccaagagataaaggaagtctggccagcagcagctagtctagaggcaggcagggaatcacctgacgcagacagcaaggggtgacagaagctggccaatcagagagctcagcacaagaggaagggcagtgaggtgcagggtggcatggaggggtcttagaggaataccattaccttgccagctttcgatcaagatgtacagtttttccttatggggaaaccagtagggcattcagcccaccaagctagtggccagttagctaagatgtatttaaccttacaggtggacagagtctccagaaggattttggcaggaaaaactactgtttatatcaagatgttacagaaaaagaaagctgaagaaatttcagcccttgctgtcattactaaactaccttaaccaatcaactgaaagttttttgtatattcagagtcattcaacaagaacttctggaaaacctgttatgttcagagctgagatagaaaggccaagtactgaagatacaatgggaaacaaggcataggctctgatctgaaggaactttaagcagtgtcctcaggtgtacactagaaaaaatttctgccttgcctccttcaaaggcttagtggcaatggtagatgtgaaagcaaagctgtaaaatattgaaaataatacaaataggaggagatgaatatcattacctatgcagctttaagtcctaacactttacttctgaagtgatcagaattcagttttgtgactttgctcttccatctttacaaaagttttctagattcctaaacaatcataccacttcccatgaaaggagctattctgcatcttcaaaaaatcattaggcatctgattcagttggctttattagtgccctcattgtacttagggagaccttgcctaagagagatgtcctgtaagtcaaccttggataaaaggtattgctttgtgtggcacagaaatcatgttaaaagccaagggcagtgataaatgggaaccaactcgttagcccagagattttatgcacagtatccctagacccactcaaattcaaaaggtgttcaaagcagagattgggaactctcagccctgtgtgccagatggtggaccctaccaacaggctcaggaaacaccaagcccttggggctgtgcatctgccatccacttccccatccctgagagcttgccaagaggccatcagcaccctcgccaaacacactcttcctatgatggtgggcactgggaatccattagcaacaatccccaaccttttcagcaccaggacccagtttcacagaagacaatatttccacagacggtggaggtgggggcagcagtttcaggatgaaactgttccacctcagatcatcaggcattagttagattctcacaaggagctcgcaacctagatccctcaatgcacagttcacaatagtgttggcaagagaatctagtgccaccgctgatttgacaggaggtggagctaaggtggtaatgctcatttgcccactgttcacctcctgctgtgcggcccagttcctaccagcccacagacctgatggataccaatccatggcccaggggttggggacccctgcattgtagtattgtgagagattaggtctgtcccaagcttcccgtcaatttcacacatccagcccactgcccactgactttgaggataggtttttgttttaattgtgtcagatatacataacataaaatttaccattgtaaccttttctgagtgtacaattcagtggcattaagtgcatttaattgttctgcaacaattatcactatccatcgccaaaactgtttcatctaaaactctgcacccattaaacaacaactctgcattccccttcccacccccagcaccaccccatgacaatcaccattctactttctgtctctatgaatttggctactctaggtatcttatataagtggaatcacacaatatttgtccttttgtgtcttatttcacttagcataatgttcaaagtttatctgtgttgtagcatatgtcagaatttcctatctgattaaggaggaataatattccatcgtatatatacaccactttttttagttcattcatccattgatggatatttgggttgtttgccccttttggctattgtgcataatgccgctatgaacatgcgaatgcagagatctgtccaaatctctgctttcaattctttggggtacatactagaagtacaattgctgtatcatatggtaattctatgttcagctttttgaagaaccaccgtgctgtctttcacaatggctccatccttttacatgccatggacacacacggactaaaggaaaggggaggctggctcaacacctggaaaagctagccactgttttaaaagttgtcaccaataatccattgatgggtcaaagtgttttcaaagaaccaagagccatttcatttattgatttattaaataaacttctgttgagcctatacttgcaactagcactggcttagttactcagaaggcaaagacaattatgatacagccagttagacttctaggaggcttgtaaaagttgattcagatgagatccatccagaggaggaaaggcaggtcttcataaagaaattattctacatgtaacttctatttgccacctcgctcgcttcctattttaattacaccatagtaactcacataaacaacttaggcaatgtaagaattgaccttaggcaatataagaagtgattaagagtatgaactctgaaagcaaacagacctagagtccaaaagcacctcctgtgtgaccatgagaaagttacttaaaccctcttagcctcagttttctcataatttttaaagggtgtgagcttacaaagtatctagcacagtgcctggtgtgaaataaacactcaaaaatgttagctgttattattattattattattattattattattattattattagacaaatacacctttttgttcctttgtagttttatgtttttttgttttaagcaggggaatggaggaagagggatctctgatttatgtttttttccctcttatggctatatatgatcctcctaaaaataaaaaatctaggacttctcaagcccgcatctctatgtatttcactctgtgctggatctcatgaggagtataatagtctttcccataaacacaaatttttatgaacgtggtatcagcaaagtgagctcttctcaagtagatacatggacctgaaaagcaaactgactttcataatttttaaaaactctttttcccaataatcgattgtgtcaaattcagaaagcatgtcatctacacaagaccagttttatagcacattgaagcccaacttcagaggacatgaaactggtaggaagctcataattcataagctccaacttgctgacttcagaggttggttttccctgggaagcctgctctcaaaaccatcctctgtgtgctcacttggacctcaggttcctaagcagttgtgcttgggttaaaatttagtaactgagaacctcaactgaagctctgtcctgagtaacactgctatgaaacatacccctctttgttggatttagagtttaggctgctttggaaagctgtctaagtcaacttccccagctgcagcacaaaagtttgcatcacagagggtgctacttgtcagtttcagttctaagctgcccacattttactcttggtaatgaaaacatcaaattcaggaactcactttcctggattgtgactttcacttgttagtgttccaagctctatccaaaagagaaacatggaagaaggtttgagatcattcttagaatcaagagttgtatttggcagtttcagggatgaaggaaagtaaatggaagggaagcaaactcttttacacactatcattgaataaggccacctttaagtgctaccatgcatttgtgttgtcactgaaattaaagacagagggagagagagagagagggggagagaagagaaggaacactctcccctccccaaataaagagtggcagtgccttgagttcaatcaactagaagttgggaacactaactgtctccatttgtaaaatggtaataataatactcaccacctgcttctcagagctggtttacgggtttgtgttcatttctgagaggggcttgagatccttgagtgaaaggtgtgatgcacagtattataattcccaccacagggtaacatatggagagggaaagaaagtgtatagatacgtatgtttctgtttaaactctgtgtgcaatgctgacttttatcttattttgcctttaagctaaactgcatgggtcacatttggagcatatgttgttatcatttgccttttttagctcaagaaaattgagtgaataacgggtattgtttccctgtttacggtggttagagtggttgagcgtttggaaatctctgacgccacacacaaaatagtagattctcttattattatgctaagggtgaggggcttcagtttgtgtttccccctgttctatcatccacatatattatggacctatttttgaaattggcacagtattatgttacaagtgaaaaattcttttcactctccttgatagaaagaacggacaatgaaagcatcacactcttggatacccatatgcctctcactcacagcctcttaattggtctaatgtgcttttcactttttgcttttttcctataatgagctttcacattagtggtcttatattttaaatccttgctgaggacgccggccccataagtgtgctatggaagaatctacacttctgcagaaggcttctttctcaatttaattttaattagaaaccaggtggtacaaaccaaaaaggttggtggtattccttggatgtaagatgtgaaatgggtttaagtaacactgtattagtcatgaggcagaaatggagtaatgttgacatgacttgaaagtagcattgttgagtaaatgaatatgtgagaagcacttgctaaactaaatgagttttgcagttgtatgcacatttgtgtaatcctgtttattgatgcctgaaacaatttgcaaaatagaaacaaatccatgaagaagaaatatgtttggaattatttgtttatatgacaatttaaaaaaaaacacaggaatccaaatgccacatttcatgcactaaatataccatatgtggaagcttcccctcagaaaattcagcagcaacctttgctgtctgatgcggaacaataagaaacaacccaatgtcttttacttgcttattcaatcaattttaatgtgagagttagtttcgtaaaaaatgtatccaaacacaatattagtatacctgtactattatcttttagaagctgatgaagaattttctactttttctttatgcattatgagtaagagtaatgactttaaaagaaaaatgtatattcgcatattttcctaaaaacaaatccatgtattttttaaggaaatatctataagcttatgatgggcactattcttaagcactttaccatcattaattcatttagtgctcattaaaattccttgattacttccaattgacagatgaggagagtgcagcacagagaagttccgtattttgttcagagtcacacagcaataggtaggcgagccagatttcaaagccagggagtccttgtctccaacatccgtgctttaaccacaacactgctgactttccacagagcagagcctccatgtatttatttgtgaatttttttttagaggatctcaggttcctggtttaatttgtcagctagacaccatcatcttatttttgcagctcagacgctagacagtctgcctccatgcctgctggctgtccttggagctgtgggactctccctctcatgcccatttctctgggcctttactttttgaggaaaaacacttgttgctgtctgactcagttaagaagtacaagtagccctagccctgccagctgcaatcccagactggatcacttctccagatttgaggttaatcaactgcaaattccattagcttcatacggagtgaaaataaagaacagacggcttcacatgggagcctgaagtcaggtgcggctcccccaggctggcctgcaggtatcagttttttctcccgcctcaaaggaacggtgcctttgatagggaggcagatcaaagaagggctgttccagaaacgcctctgctgctggaaaagctctcaaagtctacccccacgtgcaccacagaccttttttttttttttttttttttggaaagatgtagaatttgatacttcggatcattatattctggccgctgtgggaacgtttcctaggttcactctggtatgcagctgtggtaggtatgtaatgctgacaactgattcccctgcccactagacaagatggtgaagagttaggttcaaaaaggttgctgtgactttgaggtggtctttacttgagcttgaggcttcttttcacaggtcctgatggagaatggctttaaaacacaaaataaaagccgttttccaaagatcactggtgtttttcaaagaagaacaaaagtgaacttgctagaacatattcaaatgcaagctgttagtttctcattaatctaagttgcccaaacaaaagctttgctggtggaataaaggaagtattatatagcagtattgagaaagttagtaatttccttaaaaatgcacaattctattagtctccttatgggagggtccccatgatcaggtagagttcaatttccgtttgactttttaaatgccatatggccattatctaaactcttttcactttccctgaatccctacccctcaccattggctggattactgttttgcttttataattttcccttttttaattgcttatctcttcctaccccagattaaggaaaatattgtcacagttaaaacggaagaaaaatccaataactctattggtgggaacttataagctaaccaaccttgatcacaaatgttccctttctaatcatagtttgtggtggaatgaaagatgcaattgtctggaagggatgaatatgggatccatgctggcttgggggtcaaaggtcatcacatgcaaaggtccctttctctctggcaccgctccctttgtatagcatagtttggcagctatctccttgcacttcggctacctgccagtgcagctggtactgtgtctggtgcaaacaacaaagcgtcactcagcaaccagcagctctgcatgaggccacttttctcagatgacaaagaaagatgggctatacattctaccattgctgcccattaaaaggactcttaaattgcattactacaagttattgttaattatgtagtagtcactggagctgtaggagctttccagggagaactgttcggctatatgctgggagaagaaggaagtaggggaggggttaattgttgagagaaggggtagcatggagcaaagactggtgataggggaaaaaactcattcgccacgtacaatccgagtggcatgaatagggtagggccttggttctgatgatcacctctgaaggttggtaatgtgactgatgaagaagaaatcaatcagctgaaagaatctctcagatatgcagtttggaaattgtcctgccctccctccattcaaaaagctgcatttttccagcattttcatttaagaataattttaagcaatttatcacttggctgtaatgcattcgctctgggctgaaatcaataagtcctgcaatgtggagataaggcctgtttgaaggttggggaaggaggaccagaggttgcctattgtcaaatagccagaaaattaaaattaaagtggtgtgtttactccatttggccatccagggtagaaatacagctttattggtgctgttcgcatttttcaagggtggattcttggagatatttttattgaaagggtccagtttcatccacttttttagaaatcaaatcaatatatccatatgccctcaaacaaggaagaaacctctggactatttctgttgaattcctttgtactgttttgggtcggaatttgttttctctctccctgtccctctcatggctcctaaggcggtgactgaggttttcaggtctggtgattcactggcttgtccctcaacaaaaaataaaaacacacacagcttccaaaaagggttggtcgtggggctttatcagtcttctttggcttagtttgaggtttttggccattgaaatgagatgacgctgctctcgaaatgtctggcaagtttttcatgatatgtaccaaactctaacagggagaggatcccgatttgatgtaatttcattgcaacaacacagcagcaccacttttcactcttccccatccccccatgcttctccacactacacccccccctccgcccccacaccacaacccctcctgccaatcctcttcagattaaaaggaaatccaagggaaacagggcacaatgggggcagatgaaagtccacagtctttagtttctatctttccttcttgtgtctaattttccgcttcttggttgttctgatctcagctatttgcaatagttatatataatttaacattatacaaaagtattgtcatatcaaacatagtgaaatggattccaaaaacaccatctggtatttgggaatgcactgtgagttgggaacgtgagaagagatattctttgccactttgcttgggacccagccattagcagtgtaattgccaagaaaaggtgacaggctccaggcttaaaacaagtgggttcctcccccaccaacccccttcgcctattaactcttgtgagtcctaagccaaattaaaaaggactctgaggacagagcaatggagaacaaaaagaaaagaaaagaagaaaaagaaagaaaaagaacaacagaatctaatgaaaaatagagaaaaatatctgctgcattgttgtcatcattgttttgtgaagacagtagaataagaggaagtaaaatgagtccgatacaggagggtgcgaactggggatcaggttaattgtgctttaaagttatggggtctttcagtggatttgcatgatgagagttttagtccaaagcctgtttcaaaatcctcattagttttctctaatccacctaaaattatgaaggcctggattgtgaaggtcatctgtgatgattcaaccctgtttaatttcatgggggtttgcacccacttctctatatgaaaaagagaattaataattttgaattgtcttctctatcgacaattttggggactgtcatgggagagaaacaaagaaatgcagactgtacacttttatgtactttgcttaaccaatttgaaatgaaagcagttttttttgttttttttgtttttgttttttttttgtttttttgcatcctgtgtaccaaggaaaaggagttaagtgactggacagaaatcagaaagaggacttcttagcaggagataaaaataaggaaacagcaggaaaaaaaaaagcatttaaacctctcatagctatactcaatctggcattcacaacctgagtctgtatcagtttgaaactacaaaaatagtttacaagggtcacagtcatttttttctactcagtgtgtcagaagttgggatgtgcgacccagaactgccattccattacacagaataaaatgatatctggtgggtggatcgaaagcttgccaaagaagacacagtgaaagctaaccctctcagtctagctcctgtttttaaatatttatatctctggcagactttttgggggtagaggaaactgaaagctcttttgctatctgtcatttcacccaggcaaatgagagagagtctcacgacttgattttcctcgagtttggcaccaggaacaggcgatggcgtttctttgggatggtgaatttctctttgtggaaaagtggccgggaccaaggatttttacaagagccaacagccactttccatacccgcttggggcagggccaacttcccattagcactgctgttacagatcgggcctgctttgcagccggccagtgccaactgtggtcatggcctgttaggaaacctacgaggaaagccaccgtgagcctggggtggtgggaagtgtatcgctctagatcctgggcaatctggctcactagcttgcctctctcgtgaattctctctgtgatcattagttttcttcttttcctccatccaactcttaattcccttccccaaggaatcggtctccaaagtcaattgactgctgctttcttctctgcctcaccatcatctatgccccttccttagttcagggactagaatattgcattaaccttctaactttgtagggcaatactgtagtgtgtatagcagtggtgaggagcaggggctttagaatccaatagacctgcatcttaatcatgactaggctacctcctcatcgtggcctctgccacaaaataggagaatagcttatttctagcaggaatgttgcatggactgcatgaaacagtcaggagaggatctaggacactagcagtcacctagtgagcactcagaatactacaattgttcttaacataatcgactaatgcatccagttacatcagagagccttttaatgcatcccttttcagtaccaagtatcgtgttatgctaaggatgcagatagataagatgcagaacctgccctcagggagttctccattgagagacaaattcatcaactaaaaaatctctgtagctttcttccgctactcacatgctttttaatttccaatttttataagattttttacagcattgtttggcaataacaaaaacaacaactgtaatagtagcgaccactgacctgacctttcccatgggccaggccctataatgatacatctgcatctattacctattttgttcttcagatatatgctaccaatcatgattagcaaaagaaaagctggggaactggacacactaagtaactgtcctgggaatacacagctgtgatacgtgtgaaccaatgaagaacaggaatcatttctttttgtgttcttagttggacagatgaacctgattcaaaattccaggattctattctgatactgacagtggctagcttgtttcagccatagggaccataaaaagtattctttcaccaattttttagcatgtactatatgctttttgatgctctgctagacacacaaatgattcaacataaactctccccttaagaagaataaggacagtggaagggtaacaggatgcattagagcatttcaggagatggtgtttctctactccagctaggactggcccagaagagactatcagaaagggtttgaagtatgagtgataacgaatgtgcagaaatgatgaggagaggtgttccaggtggagagaaacatatgagcagaggctcgtagataggaatgagtcaggtgtgtgctgataagagttcagggctcttgcaacagacccaagttaatgaggacatgaacttggacagtgtcaggactgaggggagagaatgggcgtccgggacaatggtaccttgccaaattttatgtgcaaatttgttgcttaataaatattccttgatgaggacaacatatgctgttacttaataaatattcctgatgaggaagacatgtgctgagctgatggaaaaaaaaaaaaaaaaacgtaatcactcagtgctcagtttttctgttcactcccaagaaaccattcattgacttaagcagccaaacactcattaagtaaatgctctgcactacactaggcactgaaaatacaaagatgaacaagatatgctctgttcctttgaggagattacaatccaggggcagaggcaagcagataaagaaataattctaaagtgctgtggtagggcagtacaaaattatgaagcaggaaccctgggggcctagacagtgatgtgcttaacgtggcctggggcaatgagagaaagcagcaccgaaaaattgaggttagagttagggattgaaagtcatactcttcaaagcactttatgaatctgcaaagcactgtatgaatgttacctgtcattttcctattatttttcacaaccacaactttgaagttgagtcagcctaagaggttgactttatttttagaggtggaagaataccttaaaaatcatacggtcggtccactggttttcagatattgcaggtgaatgtgtgtgtgtgtgtgtgtgtgtgtgtgtgtgtattgctactttattaataaaatgttatttcataatttaaaattaataatatttacttcttcaagttcagccacaaagagcaatgaagttattctgatgaatgctaacatttgatattggaattatggatgatatttgcaaacacatcagcctcagttattgtctttattttggcattttgatttgaatgcctggcctcacggaaattctgatggcactgataagtagtgaaagtggtaacatctgtgggcttcttgtttgtttgttttttgttaacagcttgactcacaatctcaagatactcttcatttaatctgagccagaagcttgaaggcaagatagtgagacacttctgtttcaaagttgaaccagtaacaataccgatgatagtcctcgatattctttgacatatatatgacaatcagacacaaggagcccaaaacttgcaccaacattaaatttgtctataacatgtgattcacggggatcagcatgtcacaagttcacacacaactgaattagattgttacagcttgacaacaggactggccaagtaaatgagatatttgcctgccacttatttggagtacctgtgactcacttgtgcaattttagattaaaagtctgaattccagaaagaccattgcagagctacaatcttcctaatcaacgacatacttataagaaattagaatgtacatgcagataagcattattattttttaaacacccaagggattccgtgggcagtggaattattggtcatttgtggtattagtatttttctgtaataaaaatttgatgaaaattatttttaaaatatttccacagagattgttgatgttttcttctgagtgcatataaaaattagttgcctagcagctcaaataattacgttgtcggtctccaatataaatattatttgtaagaaaatatttattataaatattaataaatattttatatttatgttaaagaatatacttaagtctctgtgtgtatacatatagagacagagagagagacaagtatattcttttacataaatatgaaaaacagacacaaggaacccaaaactgacactaacactaaacatagatttttatttcaactttcaaaatgcaatcatgtgctctttaatgacattttggtcaatgacataccacatatatgacagtagtcccataaaattataatacggtatttttactgtaccttttctatgtttggatatgctcagatacatgaatacttaccattgtgtaacaactgactacagaattctgtagagtaatatgccgtacagatctgtagcctaggaacaataggctatgtcatatggcctaggtgtgtagtaggctataccatctaggtttgtgtaaatacactctatgatgttggcacaacaaaggtgcctaaggacgcctttctcagaacgtatccctgtcgttaagcaatggatgactgtagttaaaatatgttacgaaatgaaatttgcatctaacactgccacaacaaaacaatttagttccataaaaacacagcttgaaaaccaatggccgactcctagacttccccaatggatcatatgcaaggtaattttaggtggtatacattcttttttgttaataatggtatattttttaaatgtgcattaaatattgactttcacatttgctatcatgatatacattttcttttactattaaatgacttataaaattaagaaaggtgagttaattttttggaacttttatttttagatacagggggtacacgtacaggtttgttacatgggtatattgcctcagataatgaacccagtacccaataggtagtgttttgacctttgtccccatccctccctctcccctctagggtctattgtttccgtgtttatgttcgtgtgtgctccatgtttagctcccacttataagtgaaaacatacagtattttggtttctgtttctacattaattcacttaggattatggcccccagctccatccatgttgctgcaaagaatatgacttcattcttttttatgaatgcattgtattccatggtgtatatgtgccacgttttctttatccaatccaccattgatgggcacctaggttgattccatgtctttgctattatgaacaacacagcgatgaacatacaaagtgcatgtgtcctttttggtataatgatctatttccttttgtatgtacatccagtaatggaattaccggatggaatgttagctccgttttaagttctttgagaaatttccaagctgctttccacagtggctaaactaatttacatttccaccaacaatgtataagcatgctgaagtgaattaatttaaagcaactaatagcacaggtgaatacagaaaaaaaatatgagggtaatagataaatggctgaagtttagtaaaccttaatttaatatgtcccacttgtcaattcaagtggggaactggaggacaaaaatggtattctttggtggtaaatgaggacttgcccccatttatcctcattcctaatctaggggtggtatctttttcatgctacaagaggtcaagcatgctcagccccaagctctaatggtgtcatgtaacatatgtaccaaaccaaaaaagacttttaagtctcaactgacaatctaaaactaagccaagaccaaatatctgtaagcacaacttccttgggcttccctgagcatatctggatattttcagttgctcaatatggaaaacaggatacacaaacaggcttaaaatataaaagactatattggttcctgtcactgaaaagtccaaatatagcatggccttcagtcatggcttgatctagcaactcagtcacccagattctccattctgccttccttggagttttaaggcaagaatctccctagtctcttccccgtttatatctaacaagaaacagtctcagcattcccagaaaaaaataaaaataaaaataaaaaaacaaagtcagtctgtttgaatccatgtccatcctatgacccattctcaaaccgaaactgtggccagagggtaggagacaatgcttgaattaacacagtcatgtgtccacacctggagtggaacctggaacccataagctctaaaaggcaattagaggttgttgggattggaaacaggtgagaataaaggctggcaatgcaaccacaaatatgaggaaagaatagtaatgtcactgtaatgaaaagtctcagatttgatcttggaaagatattggatacttccaaggattggtcatagtcttcagagatatttatgaagtactcttatataaagagaaaaaagtggtgtgtctctagctaccatagatatgcatggccaatgtccaccaggatatctgtatgaatttcttcttatttaataccactttgggagtatatatccccactaccttcgaggctgggtcattgccctacttaagaatttacttactagtggctttttaaaatgagagggtagtggtataaaaataatccaatagaatgttatctggaagccaaaaaataagtaaataaataaaaccatagttttgctatttggagtcgagatttaaggtagaggaaagttaaatggctctaagaggcaaagagctgttttctaatgaaggtgttggctcccatcctagtttgcctttttttttttaggactccctgctagccctcaaaaacctgccttgagggcaaactcttcacagttcaaagttttgccctcggaagtaaggctgcattttaatagcagccaaaaatgggtgcaattcctgggtaagtgaatttcatccagcagtaagcaggtagagacggattggggagagttttggatctttcccaaagcctcttgaaaacgtaacatgtcagtggctgctttcaacgtttataattggaagactgcgaatcatagtcaactgaaatgtattaagcaaggtgcattcgcttaaattattttatctaaccctcgcatcaagcccatgaggtatatactttaccccatttcacagataagtaaacagaggctgaaggaatctcaatgacttgttccccagcacactgacagcacactgttgcatgaccttgagtcagtcccttctttctcagaaccaggtctctgtcaaaggaggccctcggccctgggaatgccttcccagctgcctctagccctcccaggcctcagaatgcttgttttgggccctcctcttccaggctgtgaggtccagatcctgggcagatgtctctcaccatatgctgagggtgatttaacaaggccaaatgggcagccccgtggttagaggcgctctcgttacatatacgccggttgctgcggcctggccagctgtcccagccctcgcccgctccttcttggagacagcagcctgcaattgcagatgccaagcagcggaagatatttttaaagctacagcatctgtctccttggcagcctccacccactggtgggccgggtgttttggagttgcctttgggcacttcacatggtttggcatctgatccattgtctaggctgccttttagagctcagctttttttgtggggtggaggggggggtcccctaaaaccaacttttgatgatgacctgggtctcccctctcagtgacatcagtgtgtctctggatcttttgtaatatttttttttaactttcctttaaaaaaaaaaaagaaaaaacaagtgatgaaagaatgaaagaaagagcatttcccctctgccagagtgggtttgaatagaaaactgcccagtagctgtgcagctgcccaaatctcgcccaccatgtccacattctgactagtgcagaacacggctttcttggcatccaaacttccctcaggcttgactattcctcaaatgtctccctggggaggtgagggatttcttttttcatttttccccgctgcttttgcaaaagactgtgaagcttcctgtctacatgcaaatagccattcaaaaaaacagacactgacacttaattccccctggcaagctgtattaagttttttccttctcttagaaaggtgcattttagggaagaccagctcccagcctgcaaactcaggcctggggacttggccctgtttcagaacaccagtttgaagatgacttctagtgaggatttcaggcctagtgacaagaaaattatctcagttggggcaacaggctcctgtgtcatggggctgggcaaggcaccagcctgcctctcactcatgacttggcaagagtgccgaatgtggtcttttctccagccaacaggcacaggcagtggctaccagaggatgccagtgggcaggagtaatcaccagggcccagccaggctggctagagggtggtgtttttaagtaaccagcatcactgggcactccttgtcccattaagccacactgatataagacccaaagaatcactaaccctcacccccacccacagagcaggagtctggagctgacataggtaactggggtgcatttcttccacttaaggtcaatgaaagatagcagtattcccgccatatgataagggaaatttctaacacttcctctatactgttctaagtgcattatacgtatttccccagctaattctcaccacaaccccatgaagttgctataatcatattctctttactgatgaggaaaccggagcactgagagaggcagtaacttacccaaggtcacctagctactatggcatggaacaaggatctcaaaccaaatgctccacccccagaacccatcttcttgaccctaaaataaagattgataaaaatgaaggctgacttaagttttaattcaacattgaaaaccaggcaactctgagttgttggttcttatttgtcatccttaatttgaaatgaaaggggatttaagaagggtgttaaaggtagaatatgggattgattccaagtatgtagccattcctggtattttcactgtgcttactgaagccagtgttccttctttgcccctgttaggcagcaagtttgacctcagactggtgaccaggaaggagcttaataaaaatgagaggtatttgaacaggaagccccacctgggcacaggcatttcagaatttttagtggctgcaggaaatccagttaaagcagaggctacttaaatgtattaattcattcaatatatttattgggtaacttctctgtattggacattgttctggttctgcatgctacaaatacagcaatacagaaaaggtataaggagttccaggtaagggaaggttctcagttttgaatggggtggtcagatgagtttgagtctgaaaagttggcatttgaataagatgctgagggaggtaagtgaggagccatgagggtacccagaggaagaaaaagaacagcaagtgccaaggtgaagtgcaaaggcaaagtgcaaaggtcaaatgcaaaagcaaattgcaaaggtgaagcacacctgatctactcaaggaacatcagggaggctgatgtgctgaaaacagagtgagtggggaagaacagtgagagatgagctcagagtgctaatggaggtagcagagactgtaatcgtgatctgtttaaataagggtagtttaatgagctattcctagtgtactcgggtgaaggaacaaaattatccaaaagtcaaggaactaacaagtctggaggtcaaaggagaatgcagtctgccccttccttgacttggtttggctctccacgcctcaggatttccttttgtaaagtaagactagccataggaatcaaggctttctactgagcaggaagatgtggcaacttcacaggaatgctaaaggagatgctcacaaggagaaagaaggagcctcctttatgatttaacacccaaaacaatagttccattgcctactgtagtgcctggaattccacctttaaatacccagccctttaggttctgaaggcactaaatggaggcgagagggcaccaaacacaaactgcacctatttcaagatgctgtcaaaaatcagaatgtgcatcatcctcttaactctgttctcaaaattcttaggcctcctttctaatgtctcataaattcatacccatggaaatgcctatcgagtattattatacttggtttcataaaatgttcagagctacagggccccaaactctcacacttaaagctttttagaaagataccgagggtctcctctgtgctttattattattgtctaataggcttagtgtgcaacagtgcaacagtccaataggtccaagaagaggcacattttactgagttttactttcacattggggcaataagaccttatctatcattcaccagctgtgtgatcttgctgggcttcagtcttctcatccattaaataagaatcacagttcttacctagtagtgatattgtgacatttagacatttagtgacattagacacaatctagaaaaaaaaaaaaaaactggcagcaaaggagagaggaaaggagacagtgacacagtaggacctgtgtccttctcacctaggaaacaacagagttggcagagtcattcattcagcacatatattgtgaacaccttccaagtgacagttgttacactagcacccacaagcctcaatatttgtttcctcgtggggaaaatgtaaaggatgggtgcctgagatacaccgtggctttaagactgcctactgggtctattctctctcactgggacaaaggtgaattccaaagcctctctagggcaagtttccatctgttgtttttctcttcctagcttttatttatttatttatttttgagatggtgtcttgctttgtcacccaggctggagtgcagtggcatgatcttggctcactacatcttccccctcccgagttcaagcaattctcatacctcagcctcccaagtggctgggactacacgcatgcgccaccactccctgctgatttttgtattttttagtagagacggggtttcaccatgttgtccagcctggtctcgaactcctgacctcaagtgatctgcccacctcagcctcccaaagtactgggattacaggcgtaagccacagcgcctggccactagctttcatttattattttatttctgtaattctagcaagtcttttaaatttgttataaaattatagcatcactttatacaggaaaagtccaccacatttcattttgatggccaacagatgataaacaaatactcatgattctattaacactctctctttaatgcccaataggcccctcccctgactctgtatgagctgtggggtcccagagatcattaaaggaatacaaagtgttcacgttattagcatgagttaccatttatataacatgtgacatacgcaaagtattctctgatgattttttataacttcctggtcttgagcatggacattttatttattatacaactatattgtttgattaaaactgtgctttggggcagattaataccgaaaacaatagttccattgcctactagatcataccagccctaaccagccattattataatgtcctccctaggaagaaaatgtttatttgttttatttatttgtttacttgtgcatttggtatcaaaagcaacattttacaaagtacatggcaagaaaagaattacactggggttttagcccaaaaagtgttgcatggtcaaataagttcaacagtgaaataggcaacttgtaaacacaacacaattttagtttgcagcattccctaaaatcactggtcaattgaacaagaagaaagggtctcatgaagggtaatcctgaaggcaagtgtgggcgttttgtttctcctgatttctccaaatctgtttggtgggagtagtagtcattcccttgcacctggatgaaaattttggcaatcttatgacttttctgacatctcttagccagtgactcaacatagagattagaatctatccgtggatgtttcctatctcctgagctggctgctgtgggcagaagacatgccttcacgcattgggagtgcctagagctcacttgctctgcctctcacaatctccctctcctttccgtctcttcctccagcttgcttatcctgatgtctggccccttcatggttggggcacagggtcagggataggggctagaaagggatgtaggaaagttcttacttaataggcattttcattagatggctttgagatctctgggcctggcaggagttgagagctgcccttttttggtcatgtgtactttcatgggactttagagggtcccctgctaggtctgccagctgcctctcccttgacttcatgtccctccttcagcggactgggactgagtccgctctcctcagctgcagccgctgatccacatcactgatgtccttgctctgagggccgtctccaccgccagctgccctttgatgccagagcccttttgtaaaggaccctgcaggagaaagatggaagactcagagcaactgaagggagtttcacgaaggactggttacaggtggagtgggcagggtacagtgacaccaacaagagaggtgacatgaccacacactggccaggcagagagttatcaccacccttaagcctaagggaacaagcaaagggaagcccataggagatgatcaactaacagaagccggggccttccctagctcagtgtctcgccaacccgcaacccagcaggggaacagcccagggaatgaatacactgaggtcactcctccagctctccaatctccctggtgtctcttagtggccaaacccaaacagaaagcagagggcaaccgagttgtctcaaggtgacccccagaggtcagtctcctagggcacagagtgcaaaagggtggagagagatttactggggaaaatggagtatccattcctgacctcaaggagagaacttaacaggtgttccaaagcttcacagactggcccctgcccaccacttcggctgcttctttgactgtgttctctcttactctgcccactcccactgttccagacatctctccgtcaccccagttgcatgcctgttccctccacctgcagtgttctttcttcactcttcacctggtgcaatcttttttcattttttatgatttattttaagcatgacttactcagggaacctctcattaaaaacctatacttcttttacacgttgatttgagcatttggaattcattgattattttcaattacattcatttctctctgcttctccggacacaagctccttgagggcaggggctttgtttggcctcatccactcctttttcctagagcctgcacatggcaggagctcaggaagagtttgctgtctaggcctcagtgtcctcaattagaaaaggatggacttttgatgcagatgaagtaaaaggcccctttgagctctccaattctctgaaatggaaatgcttctcccacaagtgagtccctcttgacttctctgtcaagaaacttcttccaggtttatacattagccagagaatacagtagggggagaaggttaggaaatctcagattacttacgagaggtgaaaaatagcattacggtggacgtatacagtttcgcaaggaaatgagcaatctcttctttgatggaatatgtgaaagccaaactggaaggaataattagattaaatagtgatgtaaactggaaaggaagcattacttcctgcactgtaccaaatgtcttacaggtgtcagtgggacccaccagctcagtaattagggttttaactgtctccacttaactatgtgcaagtggttgaaaacaggagtttcattgggacccctggcatcagaacattttggtgaagtgagctttgttctcagttactcagggtaaaaaaaaaaaaaaaacaaaaaaaacaggattcatggtgaatggatgtggtaatggcttcttttttaacccatgctacccagggctctgctagtgtgtgccctggagaaccttagaccacaaagagtgtatacccaaggtgtgccctgaggatggagccagcatacaatactctaatttgagagacagcaaggttttgttgaaacttggctcttcccctaattaggtgtacaatcttggggaaaccagaccctgaaatatctgatgcacaaagggcacatcatgatactctgacacaccgaaaaggtacctgacatacaatggaggcatcataaaatagttttaaaatttcagttttggagccaggcagacctgcattccagcccaggcttttactaatattgtttggctgtgtcaccacccaaatttcatcttgaattatagctcccacaattcccacgtgtcatcagagggacccagtaggatgtagctgaatcataagggcaggtcttttccatgcttttcttgtgatagtgaataagtcttatgagatttgatggtcttataaaggggagttgccctgtacctaccccttcgccttctgccatgtaagacatgactttgctcctccttactttccaccatgattgtgaggcctccccagccatgtggaactgtgagtcaattaaacctctttcctttataaatcacccagtctagggtatgtctttattagcagcatgagaacggactaatagagtcacttataatctggatgactttgggcaagtactcctcctctctgaccctcaactgatgtgtatgaaaactcaggtattataatacctgtatcccagacctgctcgaataatgagttctctataatatggcagcaataacaaaactacaatagatgaataggttggtcctaccttatccaaaaagtcagtctcttgtttcattcattcattcatttatttagcaagtatgtattgagggcctactatgtgcctggcccagattacacagtaatccctgctgtcaggagccttgcagtcaaagtgagctagcatagcagcagacttcaaataaatagacaattctgtgaaggaaaatgcatagtcctgtgaatgtgatgaatggtgtgtgttatttagatgacagtgctcaaggaaggctgctctaaggaagtgatatttaagctaaggcttagaggatgagttggcattatccaggtgaaatgtgggcaaaagagtacttcagattgtgggaacaggatgtgtgagagctcagaagtttgaaggagcttggaaatgaacgtcaagatggctagagttttgttaacaaggggaagagaggtgcaaaatgagactggacaggtgagcagagaccagctcacatggatttaatcctacatgcagggggaagcctttccccatacttcctttatggggcagaatccctgcctgctcctgtcttgctgactcccaaaatgacctagaagagcagacaatgctggtctaaatggtggaagatctgtgtcctaatctcagatttaccatcttatcctcataaagtgcctctttagctggtagctttattgtttgacttccaagtttgcctctggcaaaacaaggttcatttgggtaaaactatcccaaagacatcatccagcctaaaattcttacattccaaatttcatattcttgccaacttccatgggtgtcataaacactgggacagtcacctccactaacaaagagaagggctgagcatctgctctgctcattgctgccccactgccatccgtggaaagtctcaggggaagtgcttaggaaggaggaggaaacgccagggcctcacaaaggatgtgctgtcagcaagggaaacagctggcgaggacagaatgacagtattcagggcccctgccagcttttggagagggaagagaagcgttctgctccccaggagtggaggtgcaatgtgatcccctggggcggagcctctctgaggacacctggaacaaagcaacccttagattatcctcttgggcctgctctgttctctgatcagtttagcttccgacccactagtccttagattggccaaacctcttgcaattttggctgtgttggtacaggctaagtctggtggaaagttaaggtaattaaccagatgaatcaaatttacgaaaaaagttaagtatactgagtgcagggcttgaatgcacagtttggcttcctgcaagcattagccttactagctcactgctcagctctccacgtcataggctgggtggtcacattattccagaggactctgccatgcagttagaatcagaagcaaacaaatatcattcatccagcaaagctttaatgagagttacaacgtgctaagcctatgctaaaccctaaagcagcaaacaaagacatgattagtctctatctctgagaatcaggagctcatacctggttaggcaaatgttctttctttttaatttttaatttttgtgggtatataatagatgtatatatttatgggatacatgagatgttttgatacaggcatgcaatacataataatcacattgtggagaatgggatttccatctcaagtatttatcctttgtgttacaaatgatccaattatactcttgtcattatttttaaatgtacaattaagttattattgactatagtcaccctggtgtgctatcaaatagtaggtcttattcatcatttctaactatttttttgtacccattaaccatccccaccttttccccactcacccccactattcttcccagcctctgataaccatccttctactctctatgtccatgagttcaattgttttgatttttcaatcccacaaagaagtgagaacaggcaatgtttgtctttctgtgcctggcatatttcatgtaacataatcatctccagttccatccaggtggtggcaaatgacaggatctcattcgttttcatggctgaatagtactccattgtgcatatgtaacacattctttaaccgtttatctgttgatggacacttaggttgcttccaagtcttggctattgtacacagtgctacaacaaatataggagtgtagctatctccttaatatactgatttcctttctttcgactatatacccagcaatgggattgccagatggtaaagtaggctctatttttagttttttgaggaaccttcaaactgttctccatagtacatgtactgattttcattcccatcaacagtgtatgagggttcctttttctccacatccttgctagaatttgttattgcctgtcttttgggtataagccattttaactggggtaagatatctcattgtagttttgatttgcatttctctgatgatcagtgatgttgggcactttttcatatgcctatttactctttggatgtcttcttttgagaaatgtctatttgaatattttgcctgtttttctatcagattattagattttttcctatagagttgtttgaactccttatatattctggttactaatcccttgtcagatgagtagtttgcaaatattttctcccattctgtgggttgtctcttcacattgttgattatttcctttgctgtgcagaagttttttaacatgacgtcatcccatttgttcatttttcctttggttgcctgtgcttgggggtattgctcaaaaaatttttgcccagaccaacgtcctggagattttccccaatgttttcttgtagtagtttcatagtctgaggtcttagatttaattctgtaatccttttttttgtgggatggggtggagggggggataaggtctcactctgttgtccagggtggagtgcagtggcttgatctcagctcactgcagccttgatctcctggcctcaagcaatcctcccatctcaaccttctgagtagctgggactacaggcatgtgaccatcatgcccagctaattttgtttactttttgtagagacaaggtctcattatgttgcccaggctggtcctgagctccgggactcaagtgattctccctcttcatcctcccaaagtgttcggattacaggagtaagccactgcacccagcctaaatctttaatccattttgatttgatttttgtatatgagaagaaattggggtctagtttcattctcctgaatatggatatcaagttttcccggcaccatttattgaagagactgccttttccccagtgtatgttcttggcacctttgtcaaaaataaggcaaatgttttaaagtggcaatcagaaactggtgaactgtaaaacagtcaacccacctacaagatgaccctaattgttacagggtttagagaaacaagtagccagtgcaggctggggttgaagaggacaatttgcagaggtgaaaggccttaaagaacaagacactccagcaccaaggaagaaagaggataatcccaatttttagttaaattaatgaaagcgaggaggtaagacagagtgtagagaatttagaggaatgcaaggaaccactactaaaaagtgctggaagtttacaaactcaaatgtttacctgatttgggggtcccagagagtagtagtgggaactaatccagcatggctgatgtccttgtaagaagaagaaagcaccacatgaagacagagacacgcagagagaccacctggggaagacagaggcagagattggagtaatgcaactgcgagccaaggaaagccaagcattgccaggaaagcaccagagctggcaagagtcaaggaaggattctcccctacaggtttcagagggagcatgaccttgccaataccttgattttggacttctagcctccagagctgtgagacgataaatttctgttgctttaagccacccagtttgcagtacttgttacagcagccctaggaaccccatacatactcacaggcattcatttagcctcagtggaggtgcaattatccatcacagagacggtgagggggagtaaaataacacctagaaaagtgctttacactccccagaaggaattacattgccagataaaggaattgtacccacaacctgagtgaatagtgggaataaaggaggtagcaactgacagtgagaaagaacggaagaaacagtttcatgtaatcgagttacaagatgatgttcttagggctggccttaatccaatatgactggtgtccttataagaagaaaacaccacgtgaaggcagacacgcagagagaccaccttgtgacgacagaggcagagactggagtaaggcggcttcgagccaaggaaactgttttacaaggaactgttttacagctcactagctcctgattgcacttatcaagttcacgggtgaaggtataagctttagaatcaaacaggccaaaactaaaccctgctctgcctcctaccacctgtgtgaactgggttgagttatttccctctctgggccatcatattttcagctataaagtggagatagtaactgaacttaccttatagaggcaagtaacttttaaaagaactatgatacacaaagcccatagcacagagcctggcccccaacctaccaggacccaagctttgcctctggggcctcccaaacccacagctctctacaacatatgcaagcttcagtctcagcggaaatgccttcatccacctccccttaccagaattcctctcatcctccagcacctactcctgtccccttgaccattccagccctcgtggtgtccccactctgaaaccctataacacaaaattgcctttcccaccataagaccagcttgccttttttttcttttctttctttttttttcttttcttttctttttttttttttttttttttggcttataaacaacaggaatttatttttcatagttctggaggctgcaaagtccaaggtcaaggcaccagcagatttgagcccactttctgcttcacaaatggcacctccttgctgtgtcttcacatggcaggaggggtgaagcagctctctgggatctcttttataaggacactaatcccattcatactctgccctcaggacccaatcacctcccaatgaccccaccccctaacaccatcacactggtgattaggtttccacatatgaattttgggagggacataaacactcagaccataatctcttggcctctttacaaacaccacagtttggcactaagagtgaaaagataaggagagaacactgctttgccttttttttttttttttacatgccctgccttctgccccaagctgttacccacattgaaagccaaagaaagagaaaaaagaaaggcaacatattcctcaacactcacgctaagacacaggagatgctgggcactttcattcctcgtcatttcatttcactgcacttcactccatccccatgacacctctctaatgtatgtgcctaacccctgtctctccccacactttatggatctagaatagcctcctggcacatggtaggtgctcagtaaaagctattataccatgataattgtatgtcatgttataccatgacaataataaccttcagctcctcatttgggctagtatgagagaagagccaaagaaaagaaagaagattctatgtgtctctgaaaaactgtctgatgctgcagccagcaaaaagggaaggtggtgctgctttagaaacaggcttgggagcccagaatttccacatgcctagcacaccttgacccaagtctacttctaacactacccacccctgccaagctaaccgtcgagagaataatcttattattggtaacctcttcccaacaaagcctcaccacaggacagcctattaggccgtcgggccttattagtgcttgtggcagcgcggtcgagtgtaactggatctggagccctgtgctaaatgctccatctggagctactctctctgaacacggaggagggctgcaccctcctcatccttaaaagtcttctaaagaatggctcaagtttcccaaacctgctcaaagcgaagacagcatccaccatctgaggctcctcactcttatgtagacaaacctagcaaacagtggcagagacctattccccctggtcttgttcttgagaggggcactttgctaatagacttatgaattctctgtcttctgataaattcactttaaaaatatctattgaacagaaatgatatgcccggcatcattgttgtactggggttacagtagtgaacagcacagaaaaacaatctctgtctagagcagcttatgctctcctgagggaggcagagaataaatttaattttgagaaagtcaattacagggactgggaatccgttggctggggctgccattaaattgtaccgtaaattgcgtggcttagacaacagaaatattttgtctcacccgaaagctaaaagtctgaaatcaaggtgtgagcagggttggttccttctcagggctgtgagggaaggatctgccccagggctctctccttggcttgcagatggctgtcttttccctgtgtctcttcacgctgccttccctctatgtggatttgtgtccacatttcccctttttataaggacaccagtcagattggattggggcccaccctaatgatttcattttaacttgattacctctgtaaagaccctatttccaaattaggtcacattctgaggacccgggagttaggaattcaacacaggaatttgggaagggacacagttccacccatcacaatgttagaaggtaagagtgctatgggaaaaatgacacagtaagagagacaggagtaccaggacacgagggcatgctactaaacagtgtggtcaggaaagagcatccagatggaaggaaaggccctaagttgaaagcaggcctggaactttctaggaaagcagggagactaaagtggctgtagtaggatgggcaaaggggagagtagtaggagctgaggtcagacaggtgagcagagaggagccaagtcttgtacttcagccacggtatgaaccaaagtggctggagggttttgagagggacgtgatctggttactgaagtgtaaaaaatttttctcctgtaaattttggccttggggttaatagatgggcctttgaggtattacgttccctttctgcagcacgcacagtgcctgaccatctttcactgcatggactctggcccaagaccctgtatcctggtgctctaagcaggatttttatgaggctgcatctttctgtgttctgcagacctatttcctcagacttcttgggccgtgaacatcacaggtcttctgcggcacaaaccaaactggccacaatagaccaaagcattttaacgctccccaacaccaggctcttcttggccgctcatttctgtatcctaccactaacgcaacaaaggagggaagaaagcctttagcaagcaccaaagataataaatgcttctaaaattgccttcttaggaaacagaaacctgtaaaggcatttactaactgtacagtaaaaaggtggaaacagttacattcccagacatgacccagtgatatgtcattagaggaaacaatgtttgcctgtgagagtcatcacccacacccactgtgacaataagaatttgctcacttctttctcctgagcaagtatgggggcttggaccccaatgcatagctttatatattaagaatggctaacactgactgagggcctcccatgtgccacgcatgctgtaaacatttgctcatttaatcttcacagatattactgtagatagtactgttcccattttacatatgcagaaactgagcctcagagaggttatttttgccaaagatcacataagcaagctaatgaatggtggagctggggcttaaacccaaagcccctctcctgcagctcaggaactcaatttgcatgtcaaaattctgtttggtaccttctgtcatttactacccatctgaaagttttcttgtatgtttcctcactctctgattaaaaatatcatcccactatagccccaatgtttaaatattaacacagtatcctactcaatgcccatctccagtattattcctttatgaaaccttcactgatagcccctttctcccacaaaagttgtatttattctctttagactttaaaacttgaggaaaatggacgtgtgttttggagtcaaatggacctgtgctcgtatgccagctttgtgacttcggacaagctatttaccttccctgaatgtcatcttctcaataggtattgaaatgcctacctcatttggttttcatatggattaaaagaaataatgtgtggaaagtagctgaccaatagtaagtgcttattattaataaatgttggtgccttctcctatcctcttatgaccctcaaagcattctgccttatagaataattacttgtgtcttgactttgaaggtatggcctatgtcctactcatttttgttgcgcgcataggaataactcatagttggctctctataaatgcttatggaatagtgtaaggtgcaagttaatccttcttgaaaggaggtggaaggaaagagggaaggaaggaaagaaggaaggaaggaagagagggagggagggaggggagaaagagataaagaaaagaaaggaagaaggaaaaaagaaaggaaaccccatgaatgcaatgggtgggaggaagagaagccaacagctggagacccacacagccaaggaggttgagaaatcacaagggcaagttcctgttttccagagttgtccagaactggttccatcaagagttgtattcccttgttatctgctgcatacatcaagcgcacgaacacacatacactttctttttttttttttttttttttttttttttttttttttttttttttttttttgagctggagtcttgctctgtcgcccaggctggagtgcagcagtgccatctcagctcactgcaacctccgcctcctgggttcaaacaattctctgcctcagcctcccgagtagctgggattacagatactcaccaccatgcccagctaatttttgtatttttagtagagatggaggtttcaccatcttggccagagtggtctcgaactcctgacctcaggtaatccgcccgcctcagcatcctgaagtgctgggattacaggcgtgagccaccgcgcccggccaacacacatacacttttcaacagctaacaaagtggtaaaagaagggcagtttagcaaatcactcccccaagtgttaaagccaggaccacagtgaggagtaactctgtacatgtcaagaagtttccttttgttcccttaccctgcctcactgtggaagccctaaatagtcaggtaatggcgcatgacagggcagggtcaggtccctcttcctctgcctggggaaggaaaacctagttccaggcaggagttgccaagctttgctccctctcaacctgctggtagcaaatgaaggagaaggaatggagccctctgctttcactatgcataagtcaattagaacatgctgatttctctaacaggattatctttgtccttccccagagcctgttccattaaggaagtaatcaatgacctatcattcggagatgtctctgtcactcacatgctggactcctccttaactcagaaatcatgtagtaacctaaacaaccaaatgcagagttagtaatttttacttttaaagtcatttttatggccattttgcttccaccaaaaaaaaaaaaaaagtgtttgaatgctaatgggaagacctgtttttttgtgtgagcatcgttgctatcatttattactagtctcaggtgtgatgcatttctagcaagaccaggcaggaagggagagggggtaaggacatccttcattcatgaggtgaacaaagagtgtttcccatccccccatcccctcctcatcaaaaacttgaaaataatgcataaaataaacaatccatcaatcatggggaaatttgaatcacatgtagcagaatgcaaggcatatctgtaaaagtatcagtagaggatactacaaatcccccaaagcccaccatagccagagtgatcgtcttaaaccactaataggattacttcctgacccgcttcaagcttctgcatagcttcccactgttgtcaggacaaagtcctaactccgtaacagaggcgacaagaccttgctgtctctggtgcctgcctactttcctagcctcacctcagctaattctctgattccaattcactgtgccatgtacacccactcactcacacacacatatacaagctcacacacatatacaaactcacacacatgcaagcacatgtacacacgcaaacacacgaacacacttttcccctacccctactgatctttcaggccccagatcagatgtcacttcttccaggaagccctcccagaaaccttaaacttagattagatgcctttctcgtgagctcccatagcactttgtaccgctcctcttaacccttctaccgtgctttgtaattgcttgtttgcctgtctcattcccctaaccagaccactggatgaggaccacatataaactgtccaccattgtttccccagggtctcaggcagggcctagctcaataaatacttttcaatttaaaagtcattgaagagagtgaatttaatatgatgtagaaaatcttaggcaagcctggcatatagtaggtgcacaagaaatatttgtcatttggaattgaattgaattataacttggataatctcaggaatgcaaacctgaggtttaattgtatttaaggaaactaatcactggtaaatagtatagaagatggtgttcaccaaagaaaatgggtcatcatagaacaggccaaaaaaaaaaaaaaaattctaaagggaagaaatgactgtttttgcttggccctgcagaagggaaagccagtgaatctgtcagtgacactagctggccactggaaacaggtgccctgctgcaggcaggggacattcatcaggcctcatgcctccttcaaaatgctggcctccttttctcagattcactgctcaccaagcatcccataaacttcccctgcagattttcctacagggagaccatgtgctgacccaagcattcctaacccttcggcagctctgtttctcattcaaagtgaataaattggcccagctcacgcaccaggctagtaggaatctgtcctgaaaccctgctctattctgactttaagaacaaatatcatgtttctaaatttacagaactgagaaccaggcctttggactcagcaaagtacattgccttgtaaggcccagcttgagcaatcacggtcccccaccccccggaagatactcatttcttctagatacaatgggaagcaaaccaaagacttgcataactcaatgaacacaggggctgagaaaacccactgcctcagatgttggcaatgctggggcaatcagacaatgaaagaacgaccttgattcagtcaatggtcacgcaggcagaaattcaggggtgttcaacagggcctggagccactgtctttggtggtaggaacctggcacctaagccagagtaccagaaggctcaagttgtagagggggacaagtaagccttaagcaggagtctgagcaaggctccttttgggggcaagaaactctggatagggtaaggaacttgggacaatagttatcatatcctaatactgtcttccatttacagagcactgactctgttctaagcaatgaccttagtgtctttataacattatctaatttaacctttcaacaaccctatgatccaactaccacagccttccaatttacagtaaggaaaccaccctggatacgatactgaaattgtcaatatattagcatgaatgaaatgcaattaccaacatgtgggtgttgcttacctacacacacaaaaatgacaatttcatgtgattcaaccccatagttcctgtctccatgagagctggccaggaacacagatagaattaaatatgctggtgggagggaacagagaagacagaagtgaaatagaggaggggtcaatctgtcacactagctagacttgcaggagtgatggccgcagggtggacaggtcccaggagcactattgtcaagcccctgcaagaaactgtggggtttctggctaggagatctgagcccacagacaaagccaggtgttgtttcccagtcaggtcacaagtctcaggcagtcttatgctgagctgtcccttttcccaacacccagaagcccaaatagccatgcatgtctctctgtcgtcccatgtagggcctctttctgtaaacagaaatcagatcacatgttgcctgaagtcagatatgaccagaatcggtgcactgtgcaagatttcaccaatgatgaaaataactttctcctgctgcatttaacatctggtgtcacagatttttgctgagagccataaaatcactaacttgcagagaaaacctcattgttgaaaaatacatttatgggggtgtggggggatggcagccggagcctggctgtgttctgggcctgcccagtggatgatgaatttcatgaggccttggtaggaatctggggcaatagaaagacagacccaggctagcaactctgccactgactagctgagggaccttgcactggtttcttcacctcccggaacttctatttccttatctacttaaaaaaaaaaaaacagcaggataaaaatagccacgtgccagggttactgtgtggattcaatgaaataacatatgtggcagtgcctggcacaagagtaaatgctagcattttcctttcttttccttttccttttttgttccctgacatttcctttcagacccaagtctgcctgaacactgtggcatttgtggaagacgtatacatgcaacactcctgcaaagcttggcccaagtcgcagttcactgggacccctgtgctctaccttagggagaagcgctgatgttttagtctgtctttcccagtgaaatggacagtcttgggggaaagaggctgagccagttcaccactgcctggcacacacagtagatgcttaggcatttcctaaatactggagtgatctgtatgacatcatcaagaagtagcaggaagggaggaggtggtgcacctgtgtgctctgccaaccagcacccagcaagctcctggcttgtctatgttgtgttaggcctggaagtctaggaagttagtgacaagaggaggtgagcctcaagggcctcttagcttacctggcaagcaggggctgggaccaaggaatcacgctttgtagccttcatcatagacgaaggcgccaggttgggttgcctggcgggccactggccacattgaagacaatgtgttctacttgtcattcccatggctgccttcaaaattcacattaaatccagtttccctcgtgtctaattgctgccatggggtggtgtgttgagggatccgcaggatgtaattgaccctgttcctgttcttccccacagcatggccttgaccgttgaacccactccaattattgtagacctttgccaagagcacactcaatctcccacatctttctctcagcctctcccactctccaccctttctgtacctcctatggatgtctgtctctgtgtgtgtgctgcctctcaccctctgtgtcccgtcctctctctctctgcccttccctctctctctgttcccttgcccctctctccatctacctgtgtccctgcatgtggctgtctctctctgttcctcagcctccctcagttggtctctgcatccttccctcctgccccctcccagactcgccctacctgagccaccgcccccccaccccgcctcacccagctgcctgaggtcctgcacctcccaatcactctcctcatatttttaactctcacttattatctctgcatcgccatttttttggctgcgggccacagcaaacagaatgtgagaaagcaaaaactaatgagcttcttcaagagaggatagggagcttctgttatctcatttagtcctcggagtttaactcctggcacttccgtcacatctccaaatggtaagtgaaggttgttacttttcaatttggttgggctgtgtagcacatttcatcaattaaaatacaccctcggtgcagaatcacaacagggccggcaggaagggtgctagtgtgtgaggatcttttttttttttttcaaagttactttcattccatgttccatggagtggagagctgttaggaggcagctgcgtgctgaaaacaccaccaccgttggtggaatgaatgcagcactgtgcatgcaatccactgctgtgcagcaccctgatggctgaagaccctgccagacctgctgcgcctggccgggaggtggagcccaggtctctggatttagccctgaggctaaattgacctcctaacctacagagtgacctgggcaggtcactcaagctgtctgtgtcctgtttctgtctcacccgttcctctcctataggctgtaggaggaattctgtaactggaaagatctttaggaggggaaatgaatgaatggcataataaacttcaccaaccaccctgatattcattcattcaacagatacgtgtagaacactcactgcatgccagttactatgctagcctcgattcttagaaattttgggtctagaaaccccagtctttccctccacccttccctgccagaaggagggtggaattcatttttgttaccatgaaagcaaactccctcagccttctactttttctacctatgaaaattgcttaagggagaactagtgacgcaccttttaaagaattattgttgtttcctgattataaaagtcattcatttattataataaatgtttaatgcacatcaaaagaaagcacaaaatataaatcagtcacaatcctacctcccaaagataaccactgttttcaaagacacattactttttacagcaatggaaaccaacaagcctactaacagaaggctaagcccccaagagaaaagaaatttaattatttgacacaattattgagtacctacctcacatgaaggactcccttggagttacaaaagttagtaagatcttgcctttccagggcttgggaaacactgaattattggtcatttttacccagatgtcttcaaccctggcctaatgtctctaaaccagaaatataacttgagaattggctccatgtccaatttcagtgagaatgttttatccattctaaagtttcttcctcatttttttcttcccactattagaatttctctgttactaccgttcaccccctttccacttgattctttctccagtgctttactttcagaaatggtgaacactgagcagccttgtgcaatgcctaagtgattagcagtaacatcttagcagatacggatgatagaacaaagccaggtagaagatgagctgcatcacacttttgcaaggcccctgcagctggtgcctccctataggccaggattcgctgttcataaatgctctcaactggacaacactatgcagaacatcctagttctatcgccaacgtgtgctgctcaaaactctagtcccttgcaatactgcaagagagggaaggtagtagtcaaatatgtttggaaagtgcctctagacacatccagtcacaaagcacatcaacacatcaaaggatccaagaaacctggttagcacagtttaacacagcaattcccaaatgtctgaccattgatgttagaaacgctcaggaacatcctaggaaagtcatttgggaaaataaattagttgttcttattgtataagttattcatactcatgttatgttaatattataaagagaaacattggcttcggtgttattaacaacatccttctctactcttaccactgccaaagtcataattatttcacacaaggtcatcactggtctggcccctgccgagttcattagcctcacctcctacccatccagtacctgaaccttcccaaactgcttgaaatgcccccaaactcaatgtgtgccttgtcttgctgtttcactgaaatgttcatctaacttatctatgcagccaactcctactcatcttctaaggctcaagttttctcctctgtggagccacccccaaatcacccccaggagtaggatacccctccttgctcttccctggcattttgtattgggtagtacattgagtgatgcacagaagttttcaaagaaagagatgaaaatgaaccaggatccagagattaaacaaaccccaattaaagggaacacatgaagaaaatgcttgaaatagggaaaatgtaggcagagaagcagctggcatttcgaagcattagttgtaagtgacatcctgatttcaacagcattggcaatatccagacatgcaggtggtctgggatgggggaagggggtgcaaagaaccagttcccaggaaactggacttcagatacaacaggaggtcagaatagaataaactccaggcaaattaagcaaaccaggatgcaaatctgagtcactgggtactaatcattaaatagaggcaggactgactccatgttctagggcaaggctgagcccacaggtgcggagtaagtggctgcacctggagaattaaaggactgcaggacaggaagccaagcaatcattacagcttccaggtgcttctctccacatggccttgctaaggtttgcctctgcctttattatataacctcagactcccccacactatgcatttctacattcagaaccccagtctggaaacttggcttcaacctagttcgaaaatcatttgtgccctagagtttaaaattcaggattagattcatggagttgtaatgcaaagacctgttcaccacaacatgtttaaacccatgttgggagcctcaataatttgctcgtaaaataaaggtcatccatccaaatggttttggataaaataaaggtggatagtaaatatgaatgggagtctttcaagaaaaaaaatgttcattttctttcaatgcctgaagacacaacctcccaaacatctcttctaaaccaatctggcctaggcaaggtatttcatgcctgtaatcccagcactttgggaggctgaggcaggaagattgcttgaggccaggggtttgagaccagcatgggcaacatagccggaccccatctctatttaaaaaataaataaataaataaataaaaacgaaactaatctgaatagttaaggggaaaacataacagattcaggtcaagttaagaggatttgaaacataggttatattattcaatcaccaccaaaacggggagaaatgaattctaattaaatcctgaagtcctcaacccatatctaggtcacaaactgtgaagtaagaagctatacacatttggttaggatgatcctgttggcagtgcaggtaactagcaagaaactccaataaaataagaagagtccaaaaaggtctaaagtttcacatttttcagtggaaagtctaaggaataggagaggatttcctgtactttttcactttatcagtttgggctctaaagaacaatgagagaaagagatagaagtgatgaaagggtgggtgggtaggtggatgaatggatgggtgaacagagagatggttgaatgggtggatggataacatttttaaaatgtagataaagtggataaggctctaactcaggtgcttgcttggtgctttccccagaaggccacatctacttttcctagtgcttctgcaaatggtcactgcaaattccatatgcaactcaaatgtcagttggcatcgcttctgttctttaaagttctgacaaaattgctgagatgctgcccccactcccactccacattaaatctaatattcttccccaagatttctgtggattacaggatttatacattcttgatctcttaatactcagattttttgttcctactaaatctagttaacattattgcttttccttctggtatctgtcctcttctttctttctttctttctttttttttttttttttttttttttttgagtcagagtctcgctcttttacccaggctggagtgcagtggtgtgatttcagctcactgcaagctccgcttcccaggttcacaccattctcctgcctcagcctcccgagtagctgggactacaggcacccgccaccactcccggctaatttttttgtatttttagtagagatggggtttcactgtgttagccaggatagtctcgatctcctgacctcgtgatccacctgccttggcctcccaaagtgctgggattacaggtgtgagccactgggcccggccctgtcctcttctttctattccatgcggattccaacacaaaattccacttttcccctggatttaccccaaatatcactactgaaaagtttactgagactataggagaatagggaagggggactacaaaacggaatagcacagcatacaacctgagtcactgttaagcaattagacattcctcttcttaaaatctctgcaccatacctaccacttggaacttctcacttgcttaccttctcctcagaatccctggtgttctgctgctctttgtcactctctctctctctccccctctctccctcttcctcctacctctagttttttccgtcttgctctcaactccccaaattcccagctactttgtatctgtttggatctctcttcatcccttccccgcagctattcctggctgtgccacagagcctcttttttttttttttttttttttttttttttttaagacagagtcttgctcttgtcgcccaggctggagtgcagtggcgagatcttggctcactgcaacctccatctcccaagttcaagtgattctcctgcttcagcctcctgagtagctaagattacaggcgcccagttaatctttgtacttttagtagagatggggttttgccatgctggccaggctggtcttgaactcctgaggtgatccaccagccacggcttcccaaagtgctgggattataggcttgagccaccatgcccagcagctacagagcctctttatgatcagacacacccttgcaggtgtgtttggagacaaaggtttttctctttgacagggattctgccttttgcctcagagtagcaatttttctctccctccccccaccactccacctcctattccatcactaatccttagacacaccgcagccttcattaactctcttctgaattcagggctgaatgtctgtgctcctgatgtcaatctgaaaccctgacccagtccagcttcatcctggcttctttctcaaagttgttgactaaaatccattcagcatttggggtttcttaaaaaggaatcatcttggagtaaaacgattgttaccagaggctggaaagggtaatgggggatgcgcaggggaagtggggatggttaatggatacaaaaaaaaaaatagatataatgaataaggcctagtatttgatagcacaaaagggcacctatagtcaataataacttaactctacattttaaaatcactaaaagtatataattggattgtttgcaacacaaaggataaatgtttgaggtgatggatacatccatttaccccgatgtgattgttatgtattgtatgcctgtatcaaaatatctcatgtaccccataaatatactgtgtacccacaaaaatttaaaatttttaattttttaaaaaaaaggaattatcttgaaacataaagagtacacaggaccaagtgatgccagagctatgactttagttaatgtcacagcaaccctgttagatggacagatgaagaaactgaggctcagagagattaaataattatttcaaggttgcacaattttctccctccaatttattttcattcttgaaactagagtgattttttgtttctgtggccacttctttttctaagagagacatgtgatcatgccgcttcattgcttaaattcttcaatggctccctgctgtcctcagggcaaagtttatacttcttagcctggtacgcaaggccattcatgatcatttacacatacagcaaggtcattcataatcacttacacacacacacacacatgcacacacatgtttacctctcaggcctatctttctttgaaccacccgctccttgcttcctcctctgtggactctaggttctaggcttgctgaattatatattgttccctaatcacgcctccagttctctgtacatggtgttctctctgcctctcattctctctccactagaaagaaagctccttaagtgtagcgactttattttgctcatcaccgctgtaaacttcacagctagaatactgcccagcacacagtatttcctcatgtcacctaaattactctcgcagacttttcctccaggccgcatctcagatgtcacttcctcccagaagtcctcctgacatcacaatcaggttttaattctctttttctggtcccttagatcatatcatgcttacatctatcatagcattgataagactctattttctctcaactcacctgacgccttagtcagaaaacatgagagcatgactatgtcttgtacatcattgtaatattcacagtaccaaatacaggcacatggggtgagagtagtagggggacactcatctctggaaccagcatataaagccaccacaaagatgctactcttgacaatttcagaacctaagccaggcactatggcatgtgcctgtagtcccagctatttgggaggctagggcaggaggattgcttgagcctaggagttcaagaccagcctgggcaacaaagcaagaccccatttcaaaacaaaaatagaaaaattctagggcaacatgggccaagtgggtggagagagagacagaacagatacaataccttagcaatggataccatttacccttgctatgctactgtccaaagaagatatctggcatataatcagcataaaatatggatgaaagaatgactgaatgaatgaagcaagtgtcagagctggtgtgtccactcacaaacagcttttctagtttgatgctattcagcaaccccctcctcctgtagtattataaccaacatggtggaattagaaaagtgacatccaagacattagggatcaggaataacagcgtcagtgcatgtcagttatggacaatttccagttagctgtactccaccagtttctgaccccactaacaattctgcttccggataaactgtaagacatgtttcaggaggccataagagagctcatcctttctgcattcccaccaatagagtcttctccaaactctgatcagttgccttctcttcaaagcctgcctcacacactagtgtcacctggaaagaatgtcctacgagccctgcctaaaagaaaaactccttggccgggcatggtggctcactcctgtaatcctagcactttgggaggctgaggcgggcagatcacaaggtcaggagatcgagaccatcctggctaacacagtgaaaccccgtctctagtaaaaatacaaaaaaaaaaaaattagccgggtgtggtggcgggcgcctgtagtcccacttacttgggaggctgaggcaggagaatggcgtgaacccgggagatggagctcacagtgagccgagattgcaccactgcactccagcgtgggtgacagagcgagaccccatctcaaaaaaaaaaacaaaaaaaaggaaagaaaaactccttttactccaccttgagtatgtgtcaattgtgagcactcttgtggctatttgcctgggccaccttgtcatgttgtttactataaaatacatatgttctgttgacatgtaggctgaaaatcccataacagatgctggatgtattcagtgggtggctgtgactcctctagggaccacagtgacccactgtgtgcattcattatctccacttcctagcatattatgtaacttaggacatgtttgttgggaaactctcctcttctcctccaccgccccctacattaaaatcaatcctttagggtttagaaattcaatgtaattcaacaatcagttgttggaattattcctatgggcccagactgcaccaggaggtagaaaggaccctatatttcctgcggacttcctccgtaccaggcatggggccaccattccatttaatcctctcttcagtcttggaaggtagaaactatcaaccccactttacaggagagaaagttctagttttcagaagttagagtagccctcccaaggatatgtcactattagtctgagacatgatattcaatgtctgattccaaaggccacatcctttctaatcacctattgaccataggattctatttatctttttgacaaaaaaaattattattacagaattaaaatatgtaaatatatgcaaatttgctatataatatataacatattatataactatatctattataaaattgaaattattataaattattccagaaagatcctgttgaaatgcacatattatcttgggatacatgcaaagaggaagcaaagaagggaggaaatgcagtagtataagtaacttggcagagagtatggcacagaaactcaaaatggctgagtgctgatggggtaaagaattgtgggaaggaaaaggcattgaatattcattaagctgctatgatttgtcagaggcttttcatatgtttcctcattcaatcctcatacaactccatgagattattatcatgagaaaactgaggctcagagaactcagtaaattgtgtaagttcataaagcaaggaagtagtagagcttggatttgaacccaggtctttctgactgcaggggtccactctccttcctttgtcccagcctacttctgaacaggccccacgggggccttgagcgtaagtaacataaaaataggaaatgaatggaggaggagtgtagaagtgaaatggaatcaacagaggtaccatgaagagattttgcttattcccaagttagcctgggcccctgcccaatatggtacaagaaatccctggttctcagcgcagccctgccgataactgagtacaggtcacctaggaagtcataacctttccagggctcagaaaattcctctcctagaaaattagttttttgaacaaggtggtctaagacccatgcagccatgaggtccttaaaatctagaaaaagtaagcacaaaatagaatattttccacttattaattactgtccaagttccttcctgaagagctaagcatgtccagagtggacgtgttgcccaaagggtgcttctgtcactgtgttgtttgtctatctgggcctggaggaggtgataaatattgattaaggcattgatatggtgctaagggaaaaatgtattagcacacttgtacaatgccctagaggtgcagtcttccttggttctcaaggaagaattttttattcagtcaacaaacatttactgaggccccccaacacagtgctccatgccatcgatataggagtaaaccagcagccaacataggcattaaacaaataattacacaaataagtaacaacggttgtgttttatttggggtcacttggggagctgtgggaaggcttaggcagggaagtcacattgtcagatttgtacaactctggctcctacatgaattagagatgctgagataggaggccatgagaaaatccattgcaacaatctgggagagacgtgttgaggctctgaattaagccagggtcagtggggatgctcacagaccacattcttgagagatagaggagtgagctagatggatatgtaatgttcacgacactcctatggctggcgttgctggcaggagggggtgtataatactaatcaccatgcactaggcttgcttcgttcacccatccagggaggcaagatgccaagaggcacaggtgttccctgccatcgaaggaggcctctgcctctcttgattgcataaacaggcctcccgccttcctgcctccttagcatccagcatcaccccagggagccctggcctcccattcagggtgctctcagcagggaggcacaatgtctggcgggatctgaaaaagggtgaagccccttcatgggcatcctggaagggctgtgagtccattctgtgggcccagcatcgcgtgatctccacactcactgccatctgtttcctatcaaggctgaacacaagctcgtgcgtgtggtcacaattgcacagaaaaatcactcggccaacaaatatggaaatgtcagcttcattctctctctctttctctctctctttctctttctctgtctctctctctctctctcacacacacacacacacacacacacacacacacccctgacttaaaaaataggcatttaaaatattgaccctttctaagatgtcctcccccaaccccaaggaaaatataatggcatcaaattccccttgcagtccatactttatttaaagggtggatgggggaacctcaatgcacatgtacaagggccaaaccaaaataggaaatatgagcaaagtggttgcatccttttgcaatcaactattataaaagctggccatctcctgttctacaagaagacatggggtttccaaccagccaagttttattttacataattgtaaccatctcagcatgtcaattaagatagaatgttacctttgggatgggatcaattagggccctgaagattgaatttggaatcatgattagcctgttttacattttgccttcattttctaaaatatacaattgtctgattcagcccaatttttaaaaacatattgtaaacttatttatttttttaagccaaaacagacgtgggaggccagttagtaacagaaaccatagcaaaatggaggatgaggaggtggggttttctatttgattagagtcgaatcttaaatttccacagcaagaaaatattgaatgtagtgtaatggttgctggattttcttaagaactgaaatcattacaccctggctgcgatccaggttcttcccttttttaggttacaatttgaaacggtgcagaacatgctatagtattgtagtcatttatgtaatgtcattgaatcgagcttctggaaatagacaaaggactttgtgtcctgaaatggtcttctggcagaaaattgatagcaacatgagatatgctattactaggtttgcttctgcctccaaatttgtgctgactaaagtaattgagagaaagacagagagggagagagaaagagagagagggagggagggagagagaacaggcaagtgaacttacaactgtgtagggaagctaaatacttaaaacaaatgctgcatagagggaaggcacacatttcctagcagaaatgtgcaagtttttcagggtcactaaaataatgtgaacctctttgcttgcttttctgaagttgttgtttcccaattggagacaatgaatatgcaaatacatgacatgaaccccccaccaccccggtaattctcccaagccctcccctcccattccagccctccaaagtgttttgccttcattgaaaccccttgtctggagcttttgccagattcatcagaatgacaggcgagtccagcttcaccaaccaaagatgcagcctgaatgcaaatcaaacccaggcctggacactctagccaggacacatggtgttaggcacaagcccatgccctgcccatttttgccccccgcctccagtgcccttctgagatttgtcatcttcattgcaacagtcactttcagaaagaaaagttagagctgtttgcgcatgaagtgagagatatgtcaataagccccctttccacataaatagcacatcaaaatattaccaaataatgctgttgactttgccaacaggcagaggactccatctggagataatatcttccaactgagaggcatcctaagtgccctttcctaggcaacaggcaaagtgaccattctgtggctaaatcctgtcctgtctatgtgcaagggcaatcctcttcatcttccattgtgcccacaccacctacactggatcctggagttgtctgctcccatccaaaatgaattcattggtcctctttcctttgtgattacaacagcaccgtccacttctgaccacactcactatatcgaagtatcctccagagatgtccaaaatagccaataccagattctaaccagggacagagctggctggcttcaccaataatctccattcatctgctcctatcaacacagagacaacagaaaaacttgctgttgggtcagctctgcatggtgtcaggagtgacacctgaacaaagtcttccctgcttccgctagcacatgggtctctcctgtctgcgaactccaatgtaattagagtctgagccacatagatatgctttctattgttctcctcagttattcaagaaattcttgctgagcatttattacatgcaaagaacaggaaggcaacaaaggtgaaccaaatatcagtagaggtcccccagctcttcctaatcagtgtgaatccccacttattccactgacattttaagatttctgaggattcttggaggggcttgtgttcttacggtcatccaggtctacaaggtcctttctcagtgccatctctgccttggcccatgtccacctgtccatgagagaggtcatttctatttatataaaagctcttgcaaagcatttgtgagttcaggagatttttggcagatgtcactgcgatatggagagacgaggagggagtaatgacacagtaacacaacatcatgttaagcacgaaatgtaaaatatggcaccatcttaaaagcagaagattgcaagtgaaacttcactcagacctcccttagctcacgtctttccttcccaccagctcagcctcaccccacataattctctacccctttgtactcttctcttctcttccctctcaagagaaaaaagaaatctcatattctcagatgcaactgtttaaaccattctcttttttggaagggaggagggagaggagtgataatgatttctgaaggctgggtttaaaacactcataccctcagatctcagatacctttaatgagtcatcaagggttttttccctcaaacaaagacaatttcctccccttacacacacacacacacacacacacacacacacacacaaaatattgttggtgccaactgttaaaataacaaataattctgccttattacacacaaagggatatgatgccattctatttagtattccctgccattttctgatcatcttctatgtcctaggaaatgtcccaggccctccaagcatgcaaattcacttaatccttgccacaatttactgtggtaaagaaactgaagatgggagcagttacattgtccggggccacctagagcattctgatcctaaaactgttatcttaagcaataaattactctgcctcccataattcagaaggctgaattatttgcaaggtactatgagaggtataaagagcaaaaggcaggggcccaggtcacttaacatagtaagccattggaaacaaggaattacgacttcagagaaagacctgagtttgagtcccagctgtgctagggatttgttgcatgacatcaagtaagtcactccaccactctgagcctcaggttcctcatatataaaatgaaaatgctaacagtgcataccccattaggttatcttggggactcaaggagataaggcatgggaagcactcaatacagtgcttggcatgtgatgagccctgaataaatgttacctttcattagtatattgaacatgattttatagcttaccttgtggatttggcattttatgatgcttctttctgctgctgaatacactttgtaaaaatcattgagatagttaacgtcttgcttcatttatctattggagaatagtgttgtttgtcctatcaatatgtataaagtcatcctatagtattactaaatctttgtttatatttgctctaagtgtttccccagatgtttgtctgccctttaattttgcttaacatactttctgacatgcagttaatttttatgaagtcgaacctatctaaattttactttgtgattccttccattaattttaaggatttaaaaaattcctttctacacagagattagagagatatttatcaacatttttttctaggataaagatacattttaaaatgtaaagtgattcacaaaataaatagattctgaaatgtgatgttggtggtttcttctattcatgagcaacctccgtatctcatgacttgtataccttggcatagtgttaataatgatgatcacataatcctgtttgggggattaaataagaatcagatttaagtcactcatcctgagagttctttcatgagttagcccactgtccccttctcaagtagagagatttctagaacctaagaagtcacacagatctctaagaatgcattcatgaatgtgaaagatctgcttagtatggccctggccctcaaggggctctctttgttttccccataattcctgtgatacagagaaaagactttggtatgaggctgatccaggttaggagttcagccctaccctcgacagtatgattccctaaattcatacatgagaaatcccctgaggctctgtttcctcatttagaaaatggaagaaaataacagacctgatttcatacgtagatctactgtgaagattaaggtaatgcatgtaaatctcttagcacacctgacgaataacaaatgaccaacaaatattagctagttttccgttttctccaccagaagatgaccatggttgtccctaaaggccctgatgcccagcatagactctggagtaaaactcctcttactatagcaggaggcgtaaacctcaggataattctagcctgatgagactgatatggtaataactgggagatactggatccaaagtacagtgtattcatttcccaggaatgccataacaaattaccacaaactagatggcttcaaaaacaaaattttattctctcacaatgtgggaggccaaaagtctgaaatcaaggcacgggcaggtttggtctttctggagggtctgaaggagacagtcctatgcctctctcctagctttcagtggctgcgggtagttcttggtgctctccaactggtatcaacagtcttggcttccatcttcacaccaccttctcctctgtgtgtatcttcccttcctatgaggacacttgtcattggatttagggcccacccagatattccaagatgatctcatctcaagatccttaacttaattacactgcaaagttgcttgctaaaaacaaagtcatatttgttaccagtggagggtatccaggttcttggcatcttgaacaaagaactggacaaaacacacaaagcaaggaaagaatgatgcaaaaaaagcagagatctattgaaaatgaaaatacagtccacagggtgggagcaggcccaagcataggggctcaaacccccgtttacagaattttctggggtttaaataccatctagaggtttccactggttacttggtgtatgccctatgtaaatgaagaggatgaagtaaagttacaaagtcatttactcagtgtaatccctatgtaaatagagaggatttttcttgtcatagctgaagtgtttccatttgatttagttctaggaagtcagcatgaattggccttatattcccagcctccagaccctattctcctgcctcacattcacagattcaaggtgaacacattctcagggtccaaatggacacgtattttgttgggggtaggaagatgggggatggagggagtgcagggggtcgggacaggggcagccattcaacccaccatacataatttcctaccatgtagtgaaagagaccagatacagagaggtaatgataatcagcagtaccttgggcagtatttttgaagagtaaggtgatcattatctgggttgcagcatttttatcatctcctttaaacatctaaaacaacagaaaacgcagatattgaaattcgtgaaacccagaggggtaaaaatgattgcctgtgtactatatcaaaagatcaaaaagtacatctttggaggaattcatggtcaccggctgaaaatcccaaagataaacaagtcaggaaatcctcccagtttgttctgaacaggcattctcagctcaacaaggatttcttgattcttcctgctgctggcacttctattgattgggaaggaagatcccaggagggaaagcatcaaggtgatctgaataatattcttgaaaatgccaatgctttgtaaatgctaaagataaaacatgccgactatagagaggaacaagaggtatcttttgtcaaatgaaagaaaccgtttgtgttgtgcacaccacgtttacatttttttacatcctctttcatggacagtgttttgtaaattagttaaggtagttataactgtggttcctcaatttcaagacccattttcccttttccaggtcaacttcacacacactaactttaagggattcctctttatgggaattttgtaatactcagaaaattgtgactttaatgaaagtgttagagaagaaatttaatggcttaaaatcagctgtgttatttgagaacataaagagaatttcaagtccaaaaacaaaacggactaattattggttcatgtaaatcactgagcatgtagataatgaataaacatttacatgtgtttacataattttgtatgaacaaatctcggaatctatccattcttttcagcaagttttactgagtgcctgttgggccagggacgatgctactcttttcctatttaggaggtgcagtgggagagtgaaacacacgcccagtgttatcagtcctaggctgcccaacctcttctagaccttctatagtgatgggtattcactacccttctagagcagcccatgccactgttgaatcttcctagtgtccataggaaacaagtagaaagttggcgaaaatgcagattcctggagccactccagaaattctgatttagctagtgtgctgtgggacccaggaacctgtcatattaacatgcaccttgggtgactctggtgcaattgtttcccaggtggttcacacaccaatattttgaaaactacttgtccggtggagagagaaagtgtcaatcatgctgttagacctgatcggtgagcttgaggcatgcacagggctgagcctcctggtagtgagtcagagggcaggaatgggtacctcagacagtctccctggaattaccaagaaaaagtcacagttttgcagccacacagaaaaagtcatagatcactctctcatgaactgcttattgagtaccagttatgtgacatacactgttcttggtacagaggctaagcaaagaatgaaacagtcaaaaacctcatccttcttggagcttacgtgcaagtgggggaatagccctcaattgtgctccattagtttcactcatgcatgcatacattcatctgtttcacaagcatggattagatcaggcattgtaggggagtgccatagttcagaaataaacaccacagtccctaccttctaaggaacctacagtaaagggtgagagatgaactagtaaaaccttacaggacagtttatcaagtgcaaagatagaagagtctggaggtgtcatgagaactcgaaaagagccaatcaaggaaagcctcccagaaaaagtgacagtatacctaactaagccttgaaggacaagcaggaggtaacagcagccacaggcacatctacatgagaggaagacactgcatggagctcagcatgattggagcaagggtgagcagcagagaaaaccgatccaggaagctgcagaggcagcttgactatgaagacaggattgtatcctgacctccatggggagccactgaaaggtgtcaagcaaaatggagtaacttactctgatgtgtgttttggaaagatatttctgagttcagtgaaaggaatgaattaagagggcagcgagtagagtcaggaaatgagaaggacttattacaatagaacgggccacagtgacaggggcctgaatacactaaggcactgtgtatgcagatgaagaggaagggacagagctgagagatatttaagaagcggaactgagaatactcgatgactcgttaggtgtcaggagtatgaagaatgacagtccctaaaatagttggatgacaattatgttcccaaaatttctcattagcctttcccttaggattcccttagttttctatttttacatcctcctggttcctcccagtcttactgctgctcaccataagtgaaccgaattaatggagagtttggccatggtctctgtggaacaacttactcaagttgaatccacatgcttaaataccccagtcaaatttaaattatcttcagggggtcaaatcaactaataaaaaaaagaatttagtgatcatctaaggcagaaaatcccaaagaattggaaattctccttgctgagtaactgaatctggagttcatacaaaccaaattgccctctacggtattcagaaaataagggcagacctgcaaatccagaagagtggttacctcaagggggctgggggcaatgagggcagaggaaatacaattaaagaaaaggtagagatcttccattataattatggggttttattcttttgctggtggtgtaatgtaaacgttgacctttttttttttctttttttttttttttttgaggcagagttttgctttcgttgcccaggctggagtgcaatgacacaatctcggctcatcacaacctccgcctcccaggttcaagtaattctcctgcctcagcctccagagcagctgggattacaggcatgcaccaccacacccagctaattttgtattgttagtagagacggggtttctccatgttggtcaggctggtttcgaactcccaacctcaggtgatccacctgcctcagcccccaaagtgctaggattacaggcgtgagccactgcgccttgccaaatgttcatcattttatacactgtgtgatggacctgaaacgattcagacataactgagatccctttagggctctgctcactgtgatctggagaaaaggttccaggagaccctttagcaagtgacaactgtttcttcttcacctgggtactggtagattcttctatatctgaagggatcttatgcatggagagtaatgtctgttgctagttgtattctgattgcttcttgatagactaaacacatgaacctagtaaacaaaactttgaaaatcaaaggaaaacattgaaagaaagacaacagagataaatttaagccagtgacttttatatcacataactcaaagccctagacactctctagagacagacagttgagtgacccatgctgtgcctcctaccctggtttcccaccagtgtttccacctgactatatattgtactggctcaccacacagtagattattattaatgatgagttctatagtttaaagacatttcataaacaatggattttgaaaattagaaattttaatttcctccatttttccttcacagccagaatttaggcatagctagtttactatatacatgcaaacacatatgcgtaatgtatacatacaaacacacactcacagtatggttaatgaccaaatgggcccaacagaaaagagcaatataaaattactgaacaaaaggctgggcatggtggcacatgcctgtaatcttagcactttgggaggccgaggcaggtggattacttgaggtcaggagttcgagaccagcctgggcaaaatggcaaaaccccatctctactaaaaatacaaaaattagccaggcatggcggtgagagcctgtaatcccagctactcaggaggctgaggcaggagaatcacttgaacccgggaagcagaggttgcagtgagctgagatagcaccactgtactccagcctgggcaacagagtgagactccttctccaaaataaaataaaataaaataaaattactgaacaaagatcccatttttctgttggtttgttaaagggaagaagcttttttttttttttaatgtattgacttctccataaagccttctgtgatcattttatgcacactaagctctcactgagggctggtactgataccttttgtgtgagcttatagctttcactctactaagcccacaattaccactctggtacttgtcaagtcagcagatgaatgaatgaaagattaaagtacaaaatagtaacaaatagatgaacggttgaacaatttgtctggtcaattttttcacacatgaattatgttctgccctcattaaagttatgggtcatccacaatatgaacacaaatataaatttctgcaggtgttaatttcatagccagaatccatacctgacaacattttcatgtgtgaacacttagaattaaggcaaaatgtctttcttaaactaacatgtttacccttaacagtagcagtataaacagacttaggtcagagatttgttaattatctttttgcaactaacatccactttgtagatctgcgttaccatgaaaaggcttttattgggaagcatgttgggaatctctggtgcataaatctctcagaatgcaagcaaagactagcttattgcctactttttgatgacttttctttcacgaacaaaccgaaagggccacaagttgatcacaatagtttcctcactcaacagaaagaaatgaatacttaatgttaaaatccaattcagttactgttggttgggcatctgctagcaaaaggaccgggatagatggagcagtgaagtgcaaagatatccacaagttgtcaatctaggtagagttgcaggcatttcattctttgcttatttacttaactagtatttatttaacatatgctatgagccaggcacttttgctaagccctggtgatagacatatacatacaggcacggtccattcctaaagtgagtttgtagtgctataggtaaggcaaatattaaataatgggtatacgaacaaatataaattatgaacaaagttaaatgagagaaacaacgaaattctatgaaagagaataataggggataatgttctttaaaggtagggttcagatgtgacatttacaagaaagtatcctttatgctgcctcctacctgtgatccttatatttcatgttatagtgtgagtaataagggctggtataagatgcaggaagttctgtgggcatataggttaaaaaggcatttagctccagctaagcgattcttatggaaaagacagttttttgagggaagtgtctttcttcacagtttccctgaaaatggacagagatttcatatgtgaagaaaactgcatgaacaaaggaagagaggaagaaaagcaaagtgtgtctaggaaacagcaaggagttgagtatagctaaagaacaaggtatgatagggatcagattatgaaggtcctagaatgccaggccaaggagtgtaaaccttaccctataggcactagggagccatggatagcttatgagcagggtaatgggatgctcatacctgtgctttagaaacccagcatggcacatgagtggagagtgtttgtacaaaggatacactaaagttagctagaacaatgagatccagatgagatttttaaaagcaagcaaaatgtccatggttcacctgagaataatgagggcttgacatgggacagtgggtgcaaaaatggaaggacatgacaaatggcaaatgctgactaggtgatctgcctggctagacacagtccagtcctgatgggccttaataagtgagaagcttgtgtcagttgtgacactgaaatcttgaattttagaaactagaaagctggttgtgtcacatctacggaatagatcctttgtttgatttgggatatgttgaatttgggggtttgcagagccttctgtcctgcagcctttagaagttcagatccgtagcacccaagccagaatgaccaagccagaggcgagtggcttgattcactgagggagctacaatccagaccttgagtctcagggctctgcatctgttttgtttagccagggaattattataaaatatttactgtactcaagtctgggcctcccctgagaattgggatcacagcgcctaacctaatattctctgattattactgctaataattctttattggggaaatcaaatagttataacttttcactgttgttggaaaagcttgaggggtgagtcatgtattacccatagaggaactctgtccacactaggtgcgtagtaaaattaagttcaaataaaatgctgtggaagagtgtttcatttcagaaaggcttacagtcattcccttactggaaatcagtgttagagggcattaaaaggctgtatgccctctgtagcatttaatataagggctccatttttcttttagtctacatgaggttgatactaaaatttgtaagcggtaaaagcagttgcaggagactttttcatttatggtactctaccatttatgaaacacacttgccaacattgctcttctgatcctcacaacaactcagcagagtttgtgctgctgcccttcctttccttcaaagaaactgaggctcagagaagtcacaggtggtgcatagggtcacctaagtagaaagcgtcagagccaaggttgagtccagagccttatcattgtaaactgtatattcgtgtagcagtttgtagttaacaatgaactttcatgataacctgctaaattttcccaaggacccagtttggtagtccctgttgatactctttacagcagagggacttgagaagctgaatgacttgacaatagtcacatgagaggggggagctgagactcctagcctgggcactctctctccactccccaccctgggtgggcctccttctaagaccccagagggtaggatccactgattatcattactctcagacaaccaggactctcatctgttccacactacaggaccaaaatagctcccatgagttcttccttcttcacacaccctaacccgatatatactgctgaggaaaacatctttaaaaccacaggagaatcccttgaacccaggaggcagaggttgcagtaagctgagatcacgccactgcactccagcctgggtgacagagtgagactctgaaaaaagaaaagaaaagaaagaaaaagaaaaatgctgaccattccttgaaatttttcaaagattccagattcaagtgcccaagattgaatttcatcaatacatacctatacataccaccaccaatatcatccctttcatggagtttaccaaggggaaaaaagctctttgaatgccaaagccagtccccagtgccagttgctaatggcacctatgttgtcagctcagctgatcactccaggcactagccagagaacacagagtaacccttcccagcacagactgttgaaagtagcttgagtataactgagttactttgagctactcatatcgtggagcctgatagcaacaggtatcacaaagcatactctgaaagcattgaagcataatgcaggttttaccaaaagtttcttaatggagatagaggaggaggttcacattttatattacaaagcaaaacctcctttaactcattcttggaaatctctctgtttccccaaagcacctttctgtatagctgctcctccctctctcctccttcctgcaacttctctacacccattcctctcctgtagccactgctaccatgcccagtatctctctttcggtagagcaactggcacccctagccatcaaccctactcaggaaacctaagactattccttgggatctgttctctttaaagtttgggaactgttgaacagaaagagagagagctggagaaaaatacaaatctaaaaactgttaatttcattattgttcctgcccaaaaatactgacataacagccaacattttctattcctgattctttgcatactttctctctaacgctcaaaacagccctataaggcaaataaagatctccattttacagatgagaatgctgaggttcagaggaattaaaactacttaccagctacagatgtaaagtggcaggcccaaatctacctgactttaaaccccatgcattccccagcacaccgcacagagacagaacatcagaacatgttttgatgtttttcctttgggagccctgtcctcccagccattcaactcaagccagctgcagccccctcccccattccaccttgtgtttcctctggccagagggaaaaggaagtttgtcacgtttcagctgatagacccacttcctgagccagcccaaggtgctggtgcacacatggcccagctctcccatgcggagacctgcttaataccctctagtcacatctgggacatatttaaaattacctctaaccacaactgcaaagtaagatcgcagagattaagcaagtgccataggcttgcttgctaaggttcagcatgggagatctgtgtccctacttcccctactctggctctgaccaggaaaactgggcaacttaacatgggaagtttgatccaattgtttccagttgagagcaagcgcagaatccttggttgtcttctggactcagtgacttcttgcaagtggggagcaatgggaggtggtggagggtgagttgcggtgaagcaatcagccttgaaactgaactggcccaagcatgtgtcctagctctgccactcactatctgtgtaaccctgggtaagttacctaacttcccacctgcagtggtgtttccttgcctgaatatgagagagttgttaaggagtaatgatagaaagcctgcatctaaaacaaaggcttcagtaaatgtaatttatcctcattattattcccagtgggagcgttggctctctcctatcctccctaacattggggcaatcttttaacctctgggccccagatttcctcacctgcattggctggtcagaggcgatcatctctcaggtcccttcctgcattggttttctatgaagcaacctccatttggcatttattttcctgcttgttggctgaaaataaattcactcattcccaaaacctcttggaaaaagagggactctgcttggcatgggctttcattggaaacagctcttcttttccagaatagcaataaaaagcatgtgttgtttgctgtttgttcaagttcagagggaaagagaaatggtgagagtgacttcatgggacaaagagacctaggatggaatcggggtgggaggacaggtatttttagcatattaaatccgtaatctggggctttgagggaacttctactctgtgtgggtttgcctagagtacacacctgttgtgtgataaaaataacagtatggcattcttagagtcctccatcctggagtggtagtcttcaaatcagaacccagggagtgacagtcaacattgaagggtgccaaggatggggagcagggatgtgatgaaataagtattagcccatgatagagaggaggaaaaaaggagagaaagagaagcagtacgatccgggctctgatcagctgggcccctgctgttggccaagcaagcaggctttgccgggagcttcccgaaggcagctgtccagccaaccccatgcaagctcctgccaggaggcatcattacagatgagtgtctgatcagctccatcgagatcacattaaaggctctcctacccaccccccttctgaaagagtgttaccgtttggacagattttcagggtcactttctgacccatctctggaaaaacaaagactgtcagacccctcctgacttatttgctaatgggaacaaaaaccatacatctttattcaaaataaagaatgatgcccagcactagcccttggactctttgagggacttctgcttccttttcccttgcatgttccactatcctttggccactcctggaaataagtgcccttccagttaagcatgctttgactaattaatttattccatctgttctttcctctggaactttgaccatgacacaaaaggttctgaaacagatttggttcttatattgataaccaggtcaccgataatggatggagagtagagtatggaaggctgaaggaaaggggcatataagttttgtccccttacatgtgcctggcttttaggcaaatctctgatttatccagtccattaaaggcatggagacatctgaaactgcatacgaaaaaagctaatctctgcattgcaagggaatttttgaaaccttaccctattcaagttactggtagaaataacgaggaggaagagaagtaaacaaactaatgaataactgttcatgatttatgttaataaatgaataaacacactaatggatttgccgaccataagccaactcctcgaccaggtggtttatttgttttttaactctcagaacaagtttgtgagtaggtagaataatgcctgtgttacaggcaagacagctatacctcacagaagtggaataacttgctttcagacactcagaccttgagtggcagagcacaattcaaattcaggtcagcatcactctaaaatctgctactcctcccaagccacattgagacatgtgcatttctttgttgtgagtttgtctcttccagaattctgacagctcagagtctttggcaggaccccaccatgtcttcagaggtggagaaaatcagtgaccactgctagggtgggcaagctctccctgacagcttgggagaagcaaacattgccttctatgcacaggcttccttcattgagttagtcacctttatttgaagtcaaatgccatttatctaaattgacagcaggttgctgatcaaatattactgagtcttctctaggtgtgaacctgggtgagttcctctgtatacccttggttaatgccttgtgactgtgggagccagaaccgaggagtctggctcagtctaacacaaggtgacagctaacacccaaaggagaaaacagtccctctctactgtttcccacattccccatatttacagtgtgcacactgcaaacccagtctgcaatggactttttaacacaccaggtgttaccacttggaaaggtcatttttacatttgcaatctttgcattgtgttccctgctatggattatggagcaagcgaatgaaaagcaagcgtccagtgtaagtgtgtatttggttcctctgataccctgttggaagaggcttaccaagggagaggcccaggccatatgggctggggtgggggtgctggtggccaggctcagtgccccagaggttcacggtggctcttggttgatgttgaggcactctgagggagtcaggacagactttcttcagtgcaagagcaatgcccgttccagcctgaagtcgactgcgataaccttgacaacaggaacaatgagcggcacatcattttcctgaggatgcatcggtacacggaaagatctctgccaaatctcatccccttgccaaggcttccaggtgtttctttgtattcgcgcagagaactaacatcattttttccttcagttcagaagaggtggtccaaagtgtttaagcgacagtagttgcaacatgtcagagtgggaatttattatctcagccccaataggtcttaataagccttacacaactgtttaggcatttattctattaacggctgttcattctggtggcttcacctgaatattcatgatcttcctatccccagagcttcagcatagcagctgtttaaaacccacagcaaatgttcaagagagttccacaaatataaacaccctcacagctgaatgttccagctctggcctcacagaggctaagccatgaaacatttatgtggagtggtttttggagggcagcatttacaaaacttaaataatctttcccctttagggagccctcaactctgtttgaaacataaccatgaggacaaagggtccaggaggacccaagtccacgaagataactgccccctccttgcttcctcctagaaatggaggttctgaataaattctaacaggaagggagctagagtgagctgggggtgggctgggtggatgtgcaacccacttcaggggagagggccaagccagttccctgtgaaagagtgagatggtttgtacagggaatatttttactgtaaatatatcaaaagagaaggcactggtggtggtttttccaaagggatataaccaggaatgacaggattaaattagcgagagcactatatgacatgaaatttcgtgagatctccctcttgagcatatgtttcctgcctttcaagtaagaatgcaaagtagaaaaagttcaggcccatctttatgattggacaaatctcccccttgggcaagtcacttacccactttgtgcctcaatgtcctcatttataaactagaggggagggggacgttgtgtcaaagaaaatgacaaggtgatggcattgtgtaaaccggtaatgtattataattaatgtattagaaatacacattcccattgtctttgacttatccagagaagatttttaagaattagtttaaaagcataaagctaaagataagtaagcatacttttctagcctgtttgtggaagaccaagctcaccttgaccagtgaggacagtagggggaacaaggatatgggaattcagtgaaagaacatgggttgtggagtcagattaatgtggattcaaattcctgcattactgctgcaatttgggcaaataatggagcttttctgagcccagttccttcatttgtaatacataaaaaatatcttacacatttgtcacaaggtttgagatgtgtgcaatacacagcacagtgcctggcacgacatagctgctcaccagatgtgattcccttctcccacctctgctatgggagcacagctagcctgtcaccccaagcaggcccaccccacggccccctgcccatggcagtggtgatctgggagcccacagttaggtggacagacagaatagcacggtcgccagccagagatttctccagccagtacgccacctctgcaggtcaagaatctgggttcattcttccctgggaactctatgggctgaaaaagaaggagagagagaaaggctttttgaaacttccaaaggaagatgcccacccccggtcaaggccccactgcttgtgcctccccagaacgcacgtggggaatgctcacatgtgttgtgtcatctgctttttgtatccacgtccctcagtagggaactgcttctccaccttttgtaaatgtcatctttggattcacataaaaaaacgctcaaatcctttcatggtatctggaattccaaaataaaagaaatacaatgcccaacatccagtcaatgtgatgataatatcaacgtgttttttaaactgtgcaacctttctccctaatacagcttcgtatcccaagcttgaaaaaaatcataatataaatgagaatgagaaaatcaaacatggtaaaaatgaattaatgtaagcgggtgtcaaacgttataatagaggagcagagcacgtccctgggagcattgaggaagagggagtctgctgagagaagcaggggaagagctgcagagagaagggcacgatttgagtatacattttctgaatcgaaaagctggaacagttactccaaggacaggcaactgaatggacaaagttcttaagggaaggaaaaggatgatgtgacaaggaaatgacaaaaagctcctcatggctgaagtggttgagtggggagcactgttggagaaggttccagaactttgtgctgggctgagatgctggaccctatcctgtaggcagaggtggaataatatcatcagaactctattttagaagaagaatgcatgcatgtgtatgatgtttaaaaattgagttagggagaccagagacagagagatcctatgctcttgatctcaccctgccaattacccccacgaggtggctattgtttctatttccctttaacagtaaggaaactggagctcaaagcagcccatgacttgatctttagctgttaagtggcagcgctgagactcaaacacagacctcttgatttcaagtcaagggctctttttacttctcacaactcattagctactacaatcacaaaatgcagaccctgagttgctttcaggggttctgaacttctttatgctatggacccatttaacatctggtgaatcgtggacctcttctcagagtagctttttaaacacataaaagaaagtgcattgagcaactaaagttactaagtatgttgtgatcaaacatacacacattatcaaatatataactatcaaatccatgtatcaaaatatttcaaatattgtgctatggcaagaatagtgcttctgtattcatgcatcacaaagcaagctctattagagggattaatatctaccagaatttcaagatagtggtaaatgtaagtaatgtttcaagacatcttcaacaattgcaatgtgatatgaagatatctgtgatttctagagaggacaaagtcctggcttttgctaatattactgcgacttgctcaccatcctaattagtagacatgataaatttcttttagagattagtgaacataaaggtgtaatttattttctcatccaaattcaaatatccctgaataatatccatgaaccctggctaagaacctcaggaaatatttcaaatttgagatagtctataaggtgatttctaaaatatttagaaattagatctttttttttcccaaatgaaccaagaagtagaatttccatgatgaaatagttcaaagcagaaaaactctggctgaagctgtgtaggaaggactcccaagtctcctcattgtgcctcttagacccacgaacccccagtagagccaacccatgagacatctccttcacagaaaatactttgttatggtttcccagcacttgttggctgtgctcagctttctcaaggcaagggtctggaaagttttctggcgataacaagcctttcctgaaaagacactgccattccactctcaggaaagcttgctttaagggcaggtttctgaacaaacggggatcttcaggaatacgccaggggtagcactgttcatacacaggcctgcttccagtgaacagtaacggtcttgagctaataaggaaataatccattttcagcagatgaaagaagagggatcagaaaggtaacttgagctgagggtaataatggtgccaaaaacttataatggaaactatctaaagaatccaagaccctttgttagatatgaatgatttcttttttctggtgagaagtgtatggagaacttgagaagaagggcctgagtggattttatgaaaaaaacctctgtctggggaagaaggcttggggttaggttgcagctccactgtatccttcagttgcgtaacagggagggagttgaaagatgttcagaacaccacaatatgatgtgctttgtctttgaactctttcttccagattttaactgtaagttcatccatgtttccctgcaatccctctaggtaggtgtgcaatagacagcagagacagaaacaaatttaattaacaaagaattcttaacattgcacacacccagagttccccgctttgagcgtcagcatctgtactgtaataatcagcaagaatccacctaatcaagatacctatatataacaatactttaaagctcttagaggcaggattttttaaaacattgaatggatttcattgaaaatgtctaaccccgtccttaaatacgaactggaacctgtggcctttactatcaaaatacaaagaattataaaaggtatagagtgggctatcatatcagtttatagttccttttattcattcattcgtctaattattcagaaactatttattgaatgattttgatggtcgatgggctgagcgaggtgccggagaaacattgcagaacaagacctggtccttgttcgcatagaagacatagagagcagacaggcattacaccaataattactccattcctcctcattctcagccttcagtgtgactaaaagtcatccaggaagcttgcttaaaactacatattccaaaatcaccagacctgaagtggggctgaggaattagcatttttaatgagttccacggtgagtctggtgcaggttggttgaagaatcgtgtaactaatgaggctacagaacagtctttctgcgtttcctgtggctcccgagtctcctgtcccaagctttccacacaggaatgctcatttcttgctttgcagcccttagtctttgcctgcacactttcttagaactcagtctttaaacactaggtcccaagcattaaataatttatttctagggaaaactctgattcccaccaacatactctgaaaacaccttcagcattttcctgcagcttcctgttccctaacctgaaccccctgccactccactttttcagagagctgtatcgtttctctatcctgtgagattcagcaatgggagaattttcgcacccctttggacagggagagtcactttctgcttgcaaggtgcttaagtccttccaacaggaaaccattcaacagtccatcccacctgggttatcaaagggcataactttcacctcttcatgcctcctgttacaaacacacgtgttcgctcacacatccatatgcatataagtaggtttgcatataaaactatctaaataaaatctgtcattttattaatgttatcaaaagatatccattttcaaattgtcacgaacaaaccatatactgccagcagtccatatgaaaatgtgactcttctcaattctattttcataaatctaccacaaaggaaagaaccccagtctcaaagtataacggccctttctcttcctgtagataacagagttaggaccatgccttgacatgaccccgtgcctggaccttactgtgactcagcccatgactccaacaaattaaggcaagaccagttttcatctcactcccaagcacaaattgttgctgcttaataatctctgaaccaactaactatatcccagtagattctaatacttgtgaaagtcactccttacatttttaatttcttcataacatggtaatacctcactattaaaaaattaggtgcttaggggtgaactgaatgaatttgtgaaaagtgtgaattataaagtatatcttttcagagaaattttgttactataaaatacaacaaaattaagtaagtcttgcctagtggaaagcatgctgccctgccctgctttaatgagtgaatgagaataatttgtaattcacatacaaaggttgctgaattgcttttttaaatgttcctagcatagggcacacatgcttccaaaggacacatcacaggaattaagcaaagctggctctgtaaatactcaatagggatattataaaagatttaagcactggataattttttgaaatctatatcagccaaaagcttccatgattatgtgacaaacccaatttaacgtatctttttttaaatttgataaaattattttgagttatcatgaagtctaaactagtaacacccaaattgaaagattttgcttaacccaattactctgttttctgatttttataggaaagttcatatttggtgttctgccaagagcatcatgttccatgatctatctaactgaaaaaaaggagaaaactttactccagagataaagagtagcacaataataaaattagcaactgacatttatgtcacagtgtacaatttacttccaaatgctatatctttttaaattcacacttattctgtacaataagtaaagagagttattattaataattccatgttaaagtcagagaatccaagagtctataagctctttcaggatcgtggttcaggtcttctgactccagagtctacgtggtgtataatagaagttcaatgtgtattagtttaataaatgaacaaattaattaattaaagtaattaaggatatcctagctaatttaaagaaagagctactagacaaaggaaaatagtcatttcaacactaaacaactctcagatgcttaggaatacagcaatcctatcataatacatagccaggactggctacataattcgcagggcctggcgtaaaacaaatacataaggtcccttattcaaaaatcattaagaaattcaggagagtaacaacagagtattcaggcacagggtccttcaaagagcagggaaccctgatgactacacagattgttcatccttgaagcctgctctgcacagcacattttaaagcttagagcactagctcctggaagaaatgataccaccttgtggatagcatttttaatatttggtaggtgggcaggttcttggttggtacaaggaggccctgctgattcatagtaggcaggagccaaggattctagagatcttcaatggcagggacagttctgaactatgaagaatcttcctgcttcccagagagcttttgaatgttccacagatattcacatggctgaaaagcctgtttttaattatctgagcttaaaatctacctttgctttacatatcttgaattttccaggaatgtgactaccatgtcaattctggaaatgttgtgtgctgctagtttagaactttaatgacatcagtacttctcgtggcatatgaggcaccaaagtaacctacctgcatcactctgcatttgtagctgtcacatcattcaaagtgattcaacatagtagtacaaggctctgactccttcatcatatcttctggtattagccatacttttacataaaggaatatgtattattttatcataaattgttttccttttatttcccctttaaattatagttagagcattttttttcctaattggatgaaggtaggttgtaatattcagtcatttcatttcatgttggcaaaaggagatttcaaaatacttgttatataaagtggctttgggtatgaaagagttgagaaccataggtttataggcataagattacaaaatgtttgagctggaaagaatttgggggattatctaattcactgacagataaggaaattgaggctgaaacaaattctatatcttgcctaaggtcaccctgcaattattggcaatgccaggacttgaaaccatgctgttttccaggactataaaaaaaattcattctttctttcttattgtccttccttccttctttcttttcaataagtgcaactgagctcctgcaggtcaggcattggggtggtctcgataatgcagacatgactaagacacagctccagtctttaaggagatcacaggctgtctggaaaacaggacagagcccaaatatggtacagcataccttagagtaaacctatgttcaaaacattacaaggaggaaacgactgatccttttcctgggagttccaaaaagatttcccagctatagcgaaatttgaatactgaagtgggagaaaggcttggcccagtaggaatagggtcgccctcattctaagcagttgccctgcccaagtgtgcaaagccacaatggccaaaacgagaccatctgtaatcaggtattgactgcccacagcccagagacagttggagcccttaatggcaagagtacaagtagaagcacaggcttgtcattatcttacccaacacagccctgagaccaagcagagggcagggctgtttcagaacacttgggacttcatgaggttgacagggaggagggaaaagaaagggaaagtctccaggcagctccctgggttaaagggcctgataagcccctggatttctgtaggcactggccagagtgcaagctaagaaaatagcttgttgattgctgaagtgattaagtggatcgccttattgattctcacctagcttggaacagacctcaataaccaacatcaagtgctttaataagggcaaagaaagatttactggatgtgagtgcttttcattagagaggactgaggggaaataaaacatactgacccaccagtgaggggccatggcatggcttccagcctggtgactgccaaccagacaggaaggtgagtaagaggaagtcaaatgagacagcccctgggcctgagcttatcaaagcattcgaaaaaaatttccacagattgctagattgtctgcttcccttctgcctctccacactgcaaacctcaccacccaggaagcaaggacacagtcagagtggctgctgcttactgagcccaaatccaggcaccagcttggccttttggtaaagatgacctctaatcttcacctcaaccctacaaggagtgcataagtttctccacattacaaagaaggaatcaaaaactaaagaagacactcaaatggtggcactaggattagaacccagatctcggctgggcctggtggctcatgcctgtcatctcagcattttgggaggctgaggcaggaggaccacttgggcccagaaggccaagaccaacctgggcaacatggtaaaatcctgtctgtacaaaaaatgcaaaaaaaaaaaaaattagctgggcatgatggcatgcacctgtagtcctagctgctcaggaggctgaagtgggaggactgcttgagcccaagagctcaaggctgcagggatccatggttgcaccactgtgctccagcctgggtgacacagtgagaccctgtaataaaataaattttaaaaaaacaatccagataactctagcaccaaggcctataatttaaaattttctgtggacctctatttttcctctcaaggctttgagttgaatacactctaccctgcataaattggccaaatttttatttttaatcagcaattgctgtgtgtcaggggccaaccaagtattacaccagttgatcttcacaaccagtttagaagttggccctatgattagtatccccattgtagagatcagttaactgaggcttggagagttaacttgcccaagggttcttcagttagcatgcagcaaaatgggaccctgaacacaatgttgtcagaatccaggtcctaaactctaatcaactacgtcttaaagaaagtataaatgaaaaatacaggtggcagtctaagaagacacagaagaatgcaaagactacatccattcattcaaatgttcaacaaatacctattaagctccgacggtaccacaagcattttttttaaccctgaggatatagtgatgatcaaaaaaggctgtcatgggaataatttctttcggagacagcagatgataatagaggaacatataagataaataagaagaatcctgcaagagagaagtacagtgaagaaaataaaccagggcaaaatgggagggtctgctttatattgggtggtcaggtaggtttcacccaagaaagttgcctataagctgaggcttcaaggacaagaaggtactaaccttgcaaaggtttggttaaaacaccttctaggcaggagaaatagcgagtgccaaggccataaggcaggaatggacttgatgcctccacagaagaggaggaggctgcagtgatgagtgagggaatggtagaagaggaggtctgaaaggaggggcagtgaagtctcgggggcctggcaggtcatcacaagaaattaggtttcattctaattaagagaggaagccatggaagcatttgaactattttcaatgatttgcattataaaaacataattttgactactgtttggaggggacaagaagttgcagggagacaagaggggaggccactgcaggacttcagatggagcgataatgttagctcagatcaagtataagttagcaacatgaagaagtggccacatcctgaatgtaactggggaaattgctgacctgacttgccactttacacttttggaagtggacaggagctgctgcctttctgatactcccacatggtgcccccctgccagctgctttcattatgttttgaccggcttctgccaagtcagactacaaaaacttcactgaaataacagaatgtgatgccgtcatctcctctgcacaccccaggagagggttttataaagtttcacaaacaacaacacctgctaggaagccagacagctcccctgaccactgcccaggctgacccagacagaagagagaagacactggcagagaactccctgctcttctaaacagccccaggggtggtttgccctgttcactgtggtcaaagtggcattactacttcagaagaaatagaaaatgaggtgaatagaaaacagaagaaagttgaggtcacaataagataccacctcatatatttaaaggaaactgagagacgctgggtttcctcctggcacgtctgtgaaaatgcgagaaaggtctgtctaccaccaacttgtttaaaccaggggaaattcatcagaaggataatgaagaacttgacagggagcattcctttgtgtcatgttctcaggagtgaagacagctggtggcatgcaatcgtctgcaggtctgactcagggagacagaaggttgggcacaaggtgaactgtcaggagaaaaaaaaattgagagaaccttagagaagatgacctttgtacataattgatctgacagagcactgcccaccccatcactacagctgaaatatggccactctcccatgtgggaatgcacttgcgtttaagggcaccagacgccatctattaaggaaagtgtttaagcaggaaggataacatgtctgtcagtctgagctagtgattctggggactcaaacaccatgccagagtccaggattaaaaaaattctacctctattctaaataaaaaggaattttattcatcaaatgaacaaaggaacagagtgaatggcttatgacaacctcccctcctgacatttggtttgttagttgtactcagggaaaaaatgttgtccactctagagaacttcataaaaagtggttctagaattattctcagctacttgagtttgctaattcctaagggtagggtaaaagttgtccattatttcatcaacaaatatttatttagtattcatcattctgctaggaacaatattaaacaagataggcacaccagccctgccctcatgaacttaacaattcagtcagctttcaggccttttcagatatttaggcatatgtattagtctgttctcatattgctataaaggactgcccaatactgggtaatttataaagaaaaaggtttaattgactcacagctctgcatggctggggaggcctcaggaaacttacaatcatggcagaaggggaaggaagcacaaccctcttcacatgatggcaggaaagagaagtgccaagcaaaagtgggaaaagccccttataaaaccaacataactcttgagaactcactcactatcacaataacagcagcatggggtaacctcccccataattcaattacctcccactgggtccctcccacaacacatggggattatgggaactacaacacaaggtgagatttggagatttgggtggggacacagacaaaccatatcatttctctccagtccctcccaaatctcaagtcctcacatcatttcaaaacataattatcccttcccaacagtcccccaaagttttaactcattccagcattaacctaaaagtccaagtcaaaagtttcatctaagacaaggcaagtgccttccacctataagcctataaaatcaaaaacatgttacttccaagatacaatggggatacaggcattgggtagatacacttgttccaaatggaagaaattggcaaaaatgaaggggctacagtctccatgcaagtccaaaatgcagcagggcagtcaaatcttaaagctccaaaatggtccatttgactccatgtctcacatccaggtcacactgatgcaagaggtgggctcacacagccttggggagctctccccctgtggcttttcagggtacagcccccctcccagcttccttcatgggctggcagtgagtgtctgaagcttttccaggtgcatggtgcaagctgtcagcagatctaccattctggggatctgtaggacagtagccctcttctcatagctccactaggcagtgctccagtagggactctgtgtaggggctccaaccccacatttcccttccacactgccctagcagaggttctccatgagggctccgtccctgacacaaaacttctgcctggacatccaggcatttccatacatcctctgaattctagggagtggttcccaagcctcagtgcttgacttctgtgcacctacaggctcaataccacatggaaactgctaaggttagaagcttgcaccgtctgaagccacaccccatctgtatctttgccccttttagccatgcctgggatgcagggcatcaagtcctgagattacacaaagcagcaaggccttgggctcagcccacaaaaccatttgttcctcctaggctccctggcctgtgatgggagggacagctgtgaaggtctctgacatgtcctggagaatgtttcccattgtcttggcaattaacatgtggctcctcattacttatgcaaatttctgcagccagcttgaatttctcctcagaaaatggatttttctttctatcacattgtcagcccgcaaattttccaaacttttatgttctgcttccctcttaaacataagttccatttccaaacaatatatttgtgaatacataaaactgaatgcttttaacagcacccaagtcacctcttttatttatttattttattttattttttcaagaaggagtctcactctgtcacccaggttggagtgcagtggcacaatctcagttcactgcaacctctgcttcccaggctcaagcaattctcctgcctcagcctcccaagcagctgggattacaggtgtgtaccacaacacccagctaatttttttttttttttttaagatagagtcttgctgtgtcaccaggctggagtgcagtggcacaatctcagctcactgcaacctctgcctcccaggttcaagtaattctcctacctcagcctccccagtagctgggactataggtgtgcgccaccaagcccagctaatttttgtatttttaatagagacagggtttcactatgttggccaggatggtctcaatctcttgacctcatgatatgcccacctcagcctcccaaagtgctgggattacaggcatgagccaccacacctggcccacacccagctaatttttatattttttgtagagacagggtttcaccatgttggccaggctggtctcagaactcctgacctcaagtaatctgcccacctcagcctcccaaagtactgggattacaggcatgagccaccgcgcccagacccaagtcacctcttgaacaccttgttgcttaaaaaatttatttcaccagataccttaaattgtctctctcaggttcaaagttctgcagatctctagggcagagacaaaatgctaccagtctcttcattaaaggatagcaagaattacttttgttcaagttcccaataaatttctcatctccatctgagaccacctcaatctggacttcattgtccatatcactatcagcattttggtcaaagccattcaacaagtctctgggaatttccaaactttcccacatcttcttatcttcttctgagtcctccaaactcttccaccctctgcctgttacccagctctaaagtcacctccacattttcaagtatgtttatagcagcaccccactacctggtatcaatttactgtattagtccattctcgtgctgctaaaaaggactgcctgagactgggtaatttataaaagaaagaggtttaattgactcacagttctgcatggctgaggaggcctcaagaaacttacaatcatggtggaaggggaagcaaacacgtccttcttcatatgatggcaggaaggggaagggtctagcaaaatggggaaaagccctttataaaaccaccagatcttgtgagaactcactatcacaagaacagcagcatgtgggtaactatttccaagattcaattacctctcactgggtccctcccacaacctccatgtgggtattatgggaactacaattccggaagagatttgggtagggtcacaacaaacgacatcagcatatctatgacaaaggattaaattcagtttaattcaacaagactgcactggacccttattctaagtaatacaagcataacttaagaattattcatccaacaaatattgaaaaaacaacacatgtgacttactgcgttttgggagacacatagttgatttcgatctagataactctctcaaggaagctgcagtgtggtaggaatgataagacttgtacatagataagtaacaccaatgatagaaaatgataaatatcatttttaaaaagagaagtgcagatggtgaaatttaacaggaaggataaggagatgaccaattccaggagatgggcaaaatctattcactgcctcagtttcccaatgcattcattcattcactcaataaatacaacttgaatcattgccctattccagatactgttagagtcagggatgaaaactagactagaagagagagagagatgacaattccctggaattaataccttaatataggtatatacgagatacggagggaagagagaggagggaacttcccagcctgcctgtggtgagggtcagttagcaaaggaaagttttgtcaaggaaatgaccctttgctgagtgtggaagaaaagggaacatctcaggagaaagaagggggaagccacagcactctaggcaggaagataacaaagattctcaaagggagagacagggtgcatgtgggcagagggtgggggacaaggcaggggcggaggcatagggagcctctgccagttttctcagggaaatgggaggtgaggttgacagacaaggaggggaggtggtgtggtttggggaactgaaaaggcaagataggctctggaaggcttctctgggaaatgcaagaagatactaataaagaacaaataaaagacagttccaaagtagaaaccacaaatttttatgtggcattaactacacatcataatgcaaaatactccaaaaatacttagtgctctgggcatgagagtagagaaagtggagagaacacatcattggacagacagagcatgtgcgtgtgcaagggaaggggaggggtgccatgaagagttcaaatgcaagtgtgtggagtctgtcctgcctgatggactgagagaaagtggatcaaggagttggagctggaatggcaaatagttttcatctcacgcatcaactccagttgatggaacctgtgctgagaaggatcccaaagcaacctctgggtttaataggagagtggcatgatcagtctgtgaggttctcaatgagctggaaagagtggcaacaatcacaccaggcattggccatctctggaccagaggccagacaaggctgtgagaagagagaggagtaagagaagtagcaggacagggggctgtggccagagtgagatgttggaaggtgaggtttcgtgaagacatcaaggcctagaacatggctagggaaaagtttggctgactgaagaacaaggcacaatctagtgttcaaataccttcatgctgctgctcttgcctcactgaagaggtaaagtgtcttcagaagacatgtgacataagggaatggtggatggttgaagaaacacttggctgttctaatgtaaacagaagaaggagtgggaagctctcatttctccatcattatcaggctctgttctcaggaagccagagaaacctatggcatgctgcctatgcaggcctcctccagacccatggctcagacagacccgcctgaactccagcagagaaacaagcccctgaccattcccttcatcagggcaggcaggatgcaagccaacagcttctcctccagtgagccaatcccattacttttttcctttttaactttgtaagaacacgtaacatgagggccaccttcttagcaaaattttaagcacacaatacagtattattgaccataggtaaagcgttgtacagcagatctctagaactcactcatcttgcttaactaaaactgtatgtccattgattaacaactgttcatttctcactccacctagctcctggcaaccaccattgcactctttgattctacgaatttggcaattttagataccccacataagtggaatcatgcagtttcgtctttctctgagtggtttatttcatttagtataatgtcctcaagattcatccatgttgtcacatattttagagtttcttttttaaggctaagtaatattctgggatgtgtgtgtatgtgtgtgtgtgttccacattttctttatccattgatctgttgttggatatttagttcatttctacatcttggctattgtgtatagtgctgcaatgaacatgggagtactaatatctcttcaagatcctcatttcaattcttttggataaataccctgtgggactgctggatcatatggtaattctatttttaattttttgaggaacctccatactgttttccatagcagctgcaccatttggcattcccaccaacagcatgcagggttccaactttcccacatccttgcctgaatctctttttggattccggagtgacagtgtctcaggatcttggcggggaaggaccatcacctcctcataatccgtgccactctggagggctgagcacacagttctccttgtttccctgtttgccagcttgccttgtggataaatgcagagaaggattcaggattggagggaagggtgaattcacggccctacagagcatgtctaaaagcatttgtcaaaaaaagagttaatgactgcttctctgcgggaagccctaaagaaatgagtgtcctgaagtgtagaacattcgcttttacggtaggtggtgttattgttacatgttcatacagacagtgctaattaacaatcctaaaggccacatcattaaattatttctccgctaaaaaccctatgatgtttaatgcgtcccagcaattcaattatatctaaaacactggcctgaacggcaggcactattctgtggctgacaaagtgcaagttgctcttaagaacaggtgaagcttaacaaggaaagaacaacatctgacaaactacctccctgctcttctccctaacatacaccctaagaataaaaacaacagtgatattccaagaaaattaacgtgggtcttacctttgctaggctggcgatgaaatataggctttaccaaattttctgtgaagaatctgacaagattttcttaaaagatttcacccaaaataatcaaatcagtgccctcagatctatttaaggtccatcgggtttcactgttttttctctggatcctaccacccatcctttgtcatttctaaccactgcaaattgcattttgggtttgaacttggggtgacttcatggctttggtctgggtttttcctggatgtgtatcacagtcagcagagagcactttgaagagcacacaaagcctctttgtctcccactcagtgaaatatctcaagtacagagcacagtgaaaaagggcttctttccagcttaaacacacacacacacacacacacacacacacacacacacacacacacacaaaagaagctcttgcccttccctgccgcccccagctgctgtggtgagacagtctctgcacaggcacagggcccagtgcaactggccaagtggcctcagtcctctggacaaggcttggcaggcagcaccatgacagaacctcctgcttggaaggtgttggtgccgagactgcatctgggagcagcacatatgtgattccactagtttttacacaaagaggcagactatgccagtggccagctggccagctgggcactcatctgcaaccttagaagcaggagtcagggagcaacccactgatcctcttgtcatggtcttcccaagtgcccagtttccacataaaccatttcctcatcactctcctccctaacactatcccaacagtaccctcaaggaggccccactcagctctatgaggacagggggctatgtatctccttagctccataccaccaagcacactgccttacatggaacacactctcagtaaaggtttcttggatggaaagatgaatgaacagatagacagatggatgatgggtgggtggataagtgtgtgcatggatgggtgtgtgcagggatgggtgggtggatggatgggtgggtggatagaagaatcttataaaccattgttcggatcctggctcaaacattttctttttgtgagatcttgggaaaattaccaaaactaagatactacaaaactaagccttttggttttttatctgtacaaagaatgatagcagttacggtggagattgagaaaattcagtaagcacctgatagtaggtgctctgtacacattcatggtttttacccaggaactgtttatagattatcaagtcccttgcttctgtaggaggtctttcctatcactgtcgaattcattgctcacttgcatctctcccaaagggatggcagaggaaaggtagtaaagggtgcttagagtggagtgaggactacaagagggagcaccagtattgactggggatgcagggtttctaatttttctagcccagaaaaattcagacaggcatggtttggaggagacctgggttccagtcaaggccctgtccccaactagctggataaacatggcatgatcacctctcccttgtggtcctagatttcttctatgagataaactcatatgattgcatgaatgctgaagtctcttcaactcccaactctgtgattctatccttcgagatccacttaacatcttcttacctcctcattgaagcctgtcctgaccattcctgctgacaataaattctccctcttctcagaatctgtgactcttgtctgcgctatgtgtctggaaattagttcacttcatagccttgcaatgatgatgatagcaaactctcaaatcatactaactggaggaccagagattattcttagctacacacatacgcacacacacttgaacatatgcatgcacatacacacacatacacacataatcattacattctcataatacctctctatgaagtgagcaatctcaaaatctcattttacagatgaaaaactgacacataaacacacacaaaaaacttacccaagaccaaacagctttaagcactgggccaagtatttgaacccaagcaggcatgacctgctgttaccaggctgtcataggtctccttgttattcagcatctcactcctctccccagtagcttccctaagcataggggcagtggggtgctgtggctaagtcaaaggactccctgtctagaccacctgtatgtgaaccccaaatctattttactgctttgtacctctattttcccatgcataaaacaagagtaaaaagtgcactccctcgtagggttgttatgagaattaaattagttactctaagtaaagcatttagaccagacatttgctgttattgggtgtaggagcccagcctaaaacatctctgtagtctctatgcctcatacatagggaatgcttttgtgttgactcagtcaagaacatgggaggaggagtcaaacagaccaagtccagtcctagctcaaccacagattaactttatgaccttgagcatgtcagttagcttctgagtctcagttttctcatttataaaatgggaatcacacgtgctgcccagtgaatcccacaaagctgtgctactcaattcaacaagacatatgtgtgcaccgtgcataaactattagataagtggaagggtttgtaactagtttagtctagatgaaaccaccgcctgaggatatctgaaggtctctgctcgagggctgtggtcaccctacttcaaaagcagaagggacagatcccttcaaaggggccctgtttgtagaactcttgctaagccacataatgttatcacaaaagcatgttgcagagaggacctcctgattttatcaaactggagaaaccacccttccatgcccaatatgggacaagtcatgagttttcagctgtgtatggctttgttccaaggcatacgaagagttttgcctgcaatgacatataggtgcccattcggtttgttgcaagttaggaagaaattgattttacagaccagacaatataatgaaaagggcatttttagctgtttgctatttccctttggagttagacacatttatgtttcgatggcaatttaatcacttacaagttatatgacctatttaatttatctcagcctcacctaggacatttgtgaagattagagacgtagcacagcttgtggcacatgagaaatgttcagtgaatttattagtcactgttgttatcatttccctctttatagactcccaagttacatcgtttcagcctgaacgcatggacccaagagccctcaagctctgtcttgcctgttccttcaacacattgttgaactctccatggtctgaacttttcctgactcctgccaacaaacactcctttgtccccctccccatcagacagaccagtgcctgctgagacatgtgcctcctgatatgtttccccatccaggtaacatttgctaaaagacactaacaatggctctgaaagatgctaattatgatcattctacgtcatactgctcctgaatgcttgcttcctaactcataaaataggatgctaacatgcatctcaagggcttatcctgataattaaagaagatcttgcaacagttagcttttggtgcctaacacatcatcccacaacttagtgacttataataaaaaaacatttatttaactcacagtcctgtaggtttgtgatttgggctggtatcagctgtgcagttcttctgctgggttcttgatgcctgggctcagacctcaaactacattaagctcactacattcaactggtcaaaacaaatcacaaggccagcccagattcaaggagtcgggaaatagactctgcctcttgataagaattgctttaaattattgtggcaatttttgcattccaccataagtaataaatctaaatcacctgctcctcaaactaatttatttgatttctctcatatttttcattcagaaatccttgcagggccttttatacgaaactaaaaaacatttattgagcctttactatgtggacagaattgcgctaggtattggggaggaaggaaggatttaagatatgtttatgacaaaatctctgtcctcaaggtgcttataatctcattggagaaaatgtacatgcacaaagatgaattctaaggccagagtaaaataccagtttaaggcaatagtacaatagctgtcacaagggcaggtatgattaattgctaagtctattgcacagccaccatctcctaaatcagagcacagcagggggagatgggtagagtctggggtagtcagggaaggcttgtcaaaggaaagaggatttaagatgcgtcttgaaagacggtttggtccaaagcaccaaactcaaatgtctccctgacattccctttctattctttctattcagtttccctgctagggggccttctttcagaaaagactccctacagtcgtagcttgtatgattaagctctctttccaaatgctgtagggaaaaatgagggagattctaatcctgggagccatctgtcaaagggaagacctttcttgatgatagacagaattgtacagtagaaaaattatgggtgtttttagtccccaaagctggcagtgtttgtttgcttttcttctgtgggattctatttccttatcttttatctcgaatggggattcttcctacagcagtacatggaacatcacagagaatgtgaaggtaatgcttctggcatatagcagacaataaatagaatgtagttccctgtctctcatgctcctccattgcctttgccatctagatcaaatttatttagtaaatgttccattcaccctaatacttagcaattgcttcagcattaggccttcactcttgtagtcatgtggcaaagctcattccagaagatctcagtgcagcccctggcacaagtaaagtgctcagtaaatatttgtttaaacggctttcagtccctggaactcatcatgccctctcatgcctctgggcactggcccttgttgctccatctgcctgaaataagccccctttctgctttccagccaccaacgtagctaagtcccattcccttcttattattcatctcaggcatctttcctgtaggaagatttttctgcccctgtcctccacccgcccacccggccccaccttgggtttaggtatccctcctcattgttcctacagaagtgcagggaaaagcatagcatttcagaaaatggttatggaacggatggattgagggatggataagtggatggataaacagagggatagatggagggaaggatggttcagtgagataacccagtcaagaaatcaacttgccaaaagctcatttcacattttggaccaagtataaaatgcctctggtgaaacatgaattttttaaatctgacatggaagctaaactttctacaaatatgtgagagctgataattaaggatcagtttcataaaataatagacctaacatggaaaattcctgctcagcacatacacacttaatactcaccagaaacagcaggtaagcaacttaattagaaagaaccccaactaatgcataaacccaaggaacaaaagccgttcccctggaagttttcaggggcaaatttaagacaaggtccttggagacaagactccgtaccaactgtcagactcagtaagcacaagacccccaacttgacatgttggggaaagaatgtttctgtccacgaaaactgaagttagctactctcagattcccaacataaatcattttcatcctgccaaaggcttcagctagcaatgggaccaggagacctcagctctcagcttccaaatgtccgctttctctctccattcacaaaaccctcaccacccctcttcctcacttcatcatgcaacatttcccaagtgtttcaaggtcacagaaaaataaacactgtttacttaatttggaacaccatgaaatttttctttaaaaaaaaagcaaagcaatttattcaaatattaaagctaggaagaacataatatctgaatttaataaaagaaactatataacaccagtgtataatactttaaacgaaagtgtcaaacaaaagagaaagtactggcctcttcttccatatgtcctccctttaaaaaaattttttttagtttttttagggacagggccttgctacattgccctggccaatctcaatctcctggcctcaagtgatcctccccattatcctctcaaagtgctgggattacaggcatgagccaccatgcctggcctatttcctccctttccttcttcatccatgcaacaaacattcactgactgttatgtgccaagctgctaggcccttgatgtaaaacggagtagggcacaattgtttcccacaatctagaggagacactggcatgtaatacacagttactctacagtgtgagagtgcaaggagagatagatccagagtctagcggggccacagagaagaaacattcaaatcagtctgagggatcacaaaagtcttcctagagaaaacaacatctgaaggatgaaggagattttaaggacaagaggggtttgccaggcaaaaaaaaaacaaaaaaaaagcaacagtttccacacacagctagaatggtgtacacaaaagtagagcaatggatcagcctcagagaaccctgggtcattcactattactggaggaatgaggagatgaagcagaagagaacaccagagtcagatcaggaagtgtcttgtgtgcaaagccggatttgtacttaaaagctatgcaaactattgaaggctgtaagcaaacaataccataatccagcttgcatttagaaaaatgattctgtcctactgtgagtgatggatagtagggaagtgagactggaggcaaaagaccatctagaaaaatgttggaggaaacttggtgagaagtgatgaaggcctgatggaccacggcactggccgtaggaaatatggttgagggtcttttacctttggatggaaccatgtattttggatgaaacttcccaacaaaaaaatacattgtggcaaccagcattacctttggtttcctttgcatttcttttatatttgctttccataagtagctggtttgggaaaaaggcatctttagcgatcattgtggtcaggagccctacatttttgtcctatctcaatcatttatcagttgtgtatcttcaggtgagtcactcattctctctgagactcagtattttaatttataaatttgatcataaattttacctcttagctttgcataatgattaaatagaggaatgtatattattacatattattataatgtaatatatattacatattataatgtaatatttattacatattattatgtaatatattactacatattataatgtaatatattattacatattattattatttaatatattattgtttagccaaacatgttgcaaaaatgaagtaaaacaccacatactgtataatattaggaatattttggatgcaaatgacagaaaattccaccagccctggctcaaattagataaaggaatatcttggaaagtctgtgagcagatttggcttcagacacagcttgacccaggctcagataatatgtccgggatctaaatcttgactcagctcttcgggtaatggccccattctcagactcacaatgtaggctcctcatcgccccagcagcttcagatacacatcacactacacagcactgtctcttccagtaggttcttccacaagcctgggaccaccactctctgtctctttcactggcctgaactggaacatgtggtcattcctatgaccagaaaataaaattcatatattgcctttgcctatgtaaagtgctcggcccctgggacatatgaaagtataagactgagaatgagggagtggcagttctcccaaagcaaaagtagggtactgttgtcaaatgctaagggaagataccttggatgcaaagcagtctacaagtgtcccttatgcacactctcacagtcaggctgccactcaaagcctcttgctgctaatcagctggatggggattcactgaccttgctgttgttgccatcgttttgagatgagctggcccttctttccacttatgtcataatagtaaaatggttattcattgtcaagctttgaagtattcttctgaatgctctcttagcacctatgagctattcaaggatcactaggattctgcaggactcatttaagaagcacttctagaggtaagatggggcagagggcaagtgagagcttctagcaacaaagagagggcctaatgggcaggaatcagataaaagaatctgacagtaatcaatagtaattgtatttataagaggcatcctcttcctccctggaaagtacctgctaacccctagggacttacccatctctataagctttaaatcatttcaccaatcttttacatccagccaccttgagtagaccccaggagtcagttaccactttgtactccatcagaacgtgtccaagggcagggaaacacacaaacccaaaaactatgtggccatcagaaacacagaggcagccatcgaaaacacagaagatggtgcctgtcagttctttgcaagagtagagagggggtgaagcttgtcctgccctggaggtggcgacactcacacacagcaggggcccttaaaggctagatctcagtatcagtttcctttaactttattcttggatatgtttatagtttactcctctattgcaaagcaagctccttaggggtagaggccatgtctttttcatccctgaccccaaaacttaccactatccctggcccaaataggcatgtcatgaatgtgtccagaatcaatgaattcactttgctaggcactggcaaatacaaagatctaaaaaacggctttgtacttataggtcttacagccttgtagggtagaaaatgagaacacagctgatgaaatagctaaattgagggctgatttgaaagcactaaatcacatccattaccttatttgactctcaggacacccccatgatgttggcacagcagatttgttagcttcattttacagacgtgagatcagttacttgggatgcaaaggacagaaatactccaccaaagtctcatagcttagtgacagcctggacttggtcacttgactctcagatctgggttcttcccataacatttttgcagcattgcagaagattcaaagcagggatgttcggctatcaacatcaaaaatagtgaaacgaaccgagctgctaaacttaatttttttttttttttttttttttgagacggactctcgctctgtcgcccaggctggagtgcagtggtgcgatctcggctgactgcaagctctgcctccccagttcatgccatcctcctgcctcagcctcccgagtagctgggactacaggcacccgccaccatgcccggctaattttttgtatttttagtggagacagggtttcaccgtgttagccaagatggtcttgatctcctgacctcgtgatccgcctgccttggcctcccaaagtgctgggattacaggcgtgagccaccgcgcccggcctaaacttaatatttttctaaagatcagccttgtattattgaaagtgctttcttagccattctctcctctgatcaccacatcaaatttgtgtagctcttttatagataaaagaatagagacaggattgaagtgtctagagtctagactaatttgcaaaactcgtcagcaactaagttaaaactagaatctaagacctgaagtaccactcccactttgcctcctctttggccttaaaaaatgagagttggcagggcacagtggctcaagcgtgtaatcccagcactttgggaggccaaggcgagcagatcacctgaggtcaagagttcgagaccagcctgaccgacatggtaaaacccccgtctctactaaaaagacaaaaactggccgggcgtggtggcgggcgcctgtagtcccagctactcaggaggctgaggcaggagaatggcgtgaacctgggaggcggaggttgcagtgagccaagattgcgccactgtactctagcctgagcgacagagcaagactccatctaaaaaataaaaataaaaaaaagagagagagaggaagagagactcatagaattcttaaatcatagcaatggaggaaaccctcccattccttacagaatccccttgtccagcttcttgcacacctccagagagaacacattatttaccacatcggaatgtaggccatccattcttgggaatccctatcatcggtcttttcatcagaaacaaatcaaactggcttcctgtcatttccactcatttccctgcattggttcaatttcattcagtttaagtttattaggtacctgccatgtacccccacagataggtattattatgcccattttggaaactgggcctttgagagcttacaaaatttacctaaggtcacagctgggaagaggcaagcccaggtcttctgttttcaaatactatactatctgtggcttgcacttaagagtcgcaaaaatgaaaatgcaacccttcctccagatagagcaaataagaccagttttgcagacacggctccctgtatgccactatcctgttttacaagtcagtaaatgttcaggagctcccaatacaatgtatgaggttaattaataatatgtaaaagtttatagtttatacagcataatctcataaacatttattagtatgctaatagagagtaatggccatgtaagcataaaatcagacagggggctgatgtgacacagcaaaagagctgtcagaaaatccataatactctttttaaccagcaagagtattacaggcatgatctccctacagactttttcctggttgcacttctggatgaccatgagatggttgaaaagatgttggacttggaatccggaaatctgggttctcatcctggctctgcccttaaagaaagaaaaaaggttagggggtggggtattgacatttattgaaccctgctctgttccagtgctctgctaggcacttttccagtgatctctccatttgttctacctggatggacttaggcaatcacctggcacataatgcatattcaaatatatttattcaattatgctgacttgaaatgaaatcactttccctctctgggcctcagctttctcactcaatctctaaggttcttcatgtattgctctcctgatttccagaaagtcttccaccatcttttccatatatatcaggtcagtcacataaaatttaaatcatcccactgtcttgaagttaattacacggcaatgttgtgcaagagcgactggatcctcatcttcccacttcccccagtggccaagagacaggacacctggatttcatcgttcactgccatcagtgacagaggggaagtcatttgacataatgcacttcagtcagtttcctcatcagaaacactgggataataaagctctcatgacctgagatacacagtattattttttttttcttttgagatggagtctcattctgtcacccggctggagtgcagtggtgtgatcttggctcactgcaacctccaactccctggttcgagcaattctcctccctcagcctcctgagtagctgggattacaggcacgcccagctaatttttgtatttttagtagagatgggatttcaccatgttggccaggatggtcttgatctcctgacctcgtgatccgccctccccggcctcccaaagtgctgggattacaggcatgagccaccgtgcctggccttcatgggagtattttaaagcacacacataagcatttttctctctgcacaactgcttactgagtatcaactgtaagcaagctctcagcctgggacattggggatacaaagatgactaagacccagtttctgcatgtaagaagctcataatgtatgtgtgatggaaagtgaagggtaagaagtaattcttaaacaaataaagttataaagttctatggagagagagagagcaattaattacatttagatgggattttttcacaggacacttcattaaagagaaggattacatttttaacttagccataaaaaatgagcagacaattttgctgcttgcttttttccacatattatgtttatcatgcaagtagatcttatttattttaactaccaccatatagtatctcattttattaaactacagcttatctttattggtctactaaggggcaattaagttgttaccacttttacattattagattgactctccatgtacatgcttcagacacatgcaagatcttttgctagcacgaacaatcacaagtggaattactggtgtatgttccttgtcaggcattgccaaatggttccccacaggatatgggctgattaacaccactatacaaaatataagggcacataaacaatgctatgtattgcttgtgactatatttaaatacagtaaaagtacattggcaatggttatatcctgactcacctctggagagggaaaagggaaaagggccttagcaaatatcaacatctcttaaagctgaatgatggctatataagtttctggtaaatattttccatacttttctggaaagtttaaaagagttcaaaattaaactggaagattcatatcagggagaaatggggaggagtgggccctccaggctgagggaacatcaccagcagcacagaattgtaaaagcaccccatctgaggagtggccgatagcgtcactttgacccgggatgcctgggtgcgaaagagaatagaaaaggctaagtaggaagcagctgtaccaaggtctctggaccttattctgacactgacaggtaaccactggagctattcgaggcccgcaggcctgtgtgcatcttcctggcctctcacatttatctgtacaccacagacaaagtatactgactgccctccgcccctctgcctctcctcacagacctccaaacccctaaccagaagctgcaggtctgagctagagagccagggagtcaggaggccagggaccctccatggcagtccttggagataagtcaggtgagaggcgcagatgtggagaatgtacattgtctcatgcacaggtgtgaggattgggggagctctgagccagtgccatcctaagctccatgagagttcaaacaatccccagagccggcaagaagaaaattgtctcataaaacttcccattgattttagctggatccttataaatcccatggagtcagattgcttttagcaagattaatatccctgccttccccaggtgcgtctgttctctctctttctctttctctttctctccctctctaacacgtgcacacccacaccacacactcacacactttccgtcgcacacactcagccgttctgtccacagggacatgtgcacacacagacgtgcatggtttctgagtgtgtgcttctcacactccttaaacatagggttaaatgtttcccttgtcaggaaacttcgagtctgtttccttttgtaatgtgtttttcacacttatctcaaacctggctaggctttgccttatgaccaaaattttcccttgaaaacactccgagttcacataacccagagcacgggccctgcatcaatcacagggcccgatgactggtgggtcagctccatgaaccaaaacaagccactcagcaacttgttctcggcacagctggggcttcccagggttcacaggaggagaagatatctcaggtgagtcccccacccagcaaagtgtcaagctggggcccgagccatgagggggcttctcagacttataaaggagcaaacacaggtctctcctttgtccaaggaaaacacaaggaattgaggagaggcaggcttccccagcgcaggccaaactccaaatgaacttacatgcagaacatggtcccagaggatacagtttcccagcagatgcaagccttcaggacttgttattttggtgaggaaattagtgtgtgtaataagaagggaaaacatccttaacagttctttttcaaagacacatggcttagcacagacattagctcacatttgctatcatccgggaaatccagtcctcagtcaatgagggttcacagccatcacatgctgctgcacctcaagccttccccctccctggcagcttctcatccactctttctattctgagtcatcctgttaaccaaaacctaccagagagcagattttggctgataagaaagaacttttgaggaggcaaagctatgcagagatgacatgagggtccctgggcagtagagaccagtgactaggagaatgggcaactgcttgatgaggttgtgtagacacggggtttcatgcatctcttggccccatgggagacgtacaattccaagctctgtctcagaccttcacctaccactcaagtggccctgggctctccacttcagagctcctacaactcatcacaaacccctactgtctttcatagtctccccttgtgtgcgaaccctttctcctcagagagagtctgtggaatttgaaagaacaaactccatctcactttcccatcctccccacagcttttgcaggttgcatggtaaattcctgatatatcatttgattgattggagtgctttggaaaggaggtgggcacaaaaagatggccctaagatgtttactttgtctcaaaggcagacaccccagagtggaactgtgttaggatcctccccaatcgctgtagctcagaatccaagcatggtgacacacagtggagccctactgtacatcagctgtgccctaaacagggtgccatggggacagcttcaggaatttaaggcactatctcttctgcatagagcaggaaccttgggcatcagctgctgtgggtcaccttttactaaatgagtggccttgggctcacttatctcatttccaagataggaatatgaacagtctatacctcatagggttgttgtgaaatggggtgatcattacatatacatctgtttagaatagtggctggcatatttatccaataatcaatatttaccatgtgccaggcactgctctaattgctaaaaatagagcaatgaatgaaaacaacaagtaaaattccacgtcctcatggagctaataatctagtcaccctaaacaaatatcagtggtccttataattattttatttttattattgctatagcatcaggatttgtctcctccactggcctgtatctcccgggctggcaaagttccaggctcactatgggcattcagtaaacagcttttgaataggcaacaaatagatgaatccgtaattgtaacattgccatttttcctgtcaatctcaaaattatattaagcaatgtgtattggtctaggaggttgaatgttcagactcaattaatcttcacaataagcccacaggcaggtactagtattatccccatcatgcagatgaggaaactaagacaggcagaagttagagaccttgctcaggaccacttggctggggttcatgcccctattcctcatgtcatcctgcctctcagcagaacagagtaggccagatttttttcttttttgagatggagtctcactctgtcacccaggctggagtaatggaggggctttatctcggctcactacagcttctgccttctaggtccaagtgcttctcttgcctcagtctcccaagtagctgggactacaggtgcccaccaccatacccagttaatttttgtatttttagtagagatggtgtattgtcatgatggccaggctggtctcaaactcctgacctcaggtaatccgcccgccttggacttccaaagtgctgggattacaggtgtgaaccactgcaccctgcctggaatagggcagatttttaaaatgcacagcagacaatattcccacgactggaaagaaatcagccaccgcttggacaactgcagtcattcctaactcacctgcctgaccttggttccatcccaactcatcttcaacccacttacacaaagctgtcagctggtcaccctacatggcaggcctgcaggtgtgatctagttgcctagtcactttacttaaaaaaccccacccctataagtccctgctggctttaaaattgttcttcaaactttattttactgctatccacagtaaaaaaaaaaaaaatacatttgatgtgataacccagtacatacaaatgtatataaatagaattaaaacaaggtgcaactccatctctactaaaaatacaaaaatttgccaggcgtggtggcatgtgcctgtaatcccagctactcgggaggctgagacatgagaattgcttgaacccaggaggcagaggttgcagtgagcagagatagcactgctgcactccggcctgggcaacagagcaagactctatctcaaaaaaaaaagagaatgatagtaacaacactcatcttatataagactaaatgatattgtacatattaaattcttagagtatgcctggctgcctggcttatagcaatgtaccataataaatatataatatatataatacataaaatcatgtttgctagcatcattattattattttaaatagaaataacagtaaacatgcattagttttcattaagatactatagtgcctggctctgacttagcagggaaacctacagacataggacatgtgtccacagtctgtagctacatgattaaattgactattttagaaataaagccaacagcatgcttgaggcaaattttaaaacagattcagatcgattgccctaaagatcccagttgtcccaaactacaggttagaagacaactttccaactgaagagcaatttcatctctcctggtgtcttaatgtgcccagagtcacaaactttggcctgcaacattcctaacagagatgttcctaatgatgtggctcaggttattgggaagtgaggtggtcagagtctcccatttgaacatctgcttttgcataagcacaagcaatggctttttattctccagaactcaggcttattcccaaaaggcagacacccaggttaacagtcaagccctacaagatgccaaggcagtctatcaggaaaaaggaaaaaccccaggtcataagtcacctggaaggcagtttaattataaaatgtgtgaagctgagttttaaatgtgaagggtcatcctggctgtttccttggacctttggaaaagtgttaactagttatcattatatgaaatttatgaatgcaccaaacccagggctatttattatttccttggcacctctaccatttgcagttacaaggagctgaaatgtgcactgtttagacattccattgcaggcatcaggcaaaagctttaaatgcaagcatttataacgatagtctgatcaccaaaaactctaactttgagacatgtttagcatccttaagtaatatttaaacagccactctatccttccttcgccttctccctcctacagtccaacattgtctttttttctatctacacaactgactctctctctctctctccccaccccctcagtttctctctttttttctctctctcacccctactccattttcaaaagacaattattgctgatggagattgcctggcacaagatgtgtgggtgtagattagtcactaagtgtcctgggggtcactccaccccaaccaaacaccagctccctccagttacagtggggaggatgggatgacagtcttcgctgtcattcaccctttctctacctgtcacgctgttaagatccccaaaaagggatcttggcagatgttaccagaggccttttttttctttctttttttttttttttttttgtaaactcacattcaaatttttattctacaaataggctggggacagggcagcatagagaaagagggattctggacccaagatgaatagatgttggtcctccaccctcaacctggtcacagtccagtaagggacacactgctatgccagtagttgcagccattgtgtttgaagcctgagcagcctcctatgccacatcgagagagctgaaccgggggtgtgctggtcagtgttaaacaaccagctgtccagggggaaagaagccctaatttgcagctcttaccaatttctgtgatgtaaatgcttcccacttgatcaatttcaagctgccaacatgacctcacggaacagaagagatgcgcaagtagctcgctgccacacagccgccatggatgaagtcaccttgagagtctggaacatggtaaaatataataaagtaatttggaggcaatgatttttgtgtatttattaactgttttaaatatattttatttaattgagaattgataccatttaatttttaatagtggctgtgtttgacgaccagcttacaaaatttctgtagcttttaacagttggccctcatgagcagttgcaatccactccagtgcaccactgggacgacttcacttggatagagggctgaccagtgcaacagtgtcagaacagggattccaggtggcaattcaagaggccagatgtgaactgacagcttacttgaagccatctggaatggtaagaaatacaggactaggccaagccaatatttacagagagctgaaagccagacacataggagataaagtcctaacactagaccaaaagagctgaaggcagacttcacaaagaacatgcagatcagaacagggctggggccaactcctgtttaaaaaaagaatagttcaggaacaagtgaggagggttttggaatgtgtcacagatatctgtgagacctacaccgctcacatgtattagtgactaatcatgataattgctcaagtttattgagcacttaatgtagaccaggtgcagttttaagtgctttacatagtcgatctcactattgatagctccattttacagatgcaacaggcagcctaaccccagaggagactgtggttgtacctgctatgcagtacaggtacatgtgtgtgttagacgggtttaaaatgtcatagagaaggcaaaaaatacatgaagaaatactccaaagtggaataaacacctgattcccagacaatgctcaaatacttggtgtaaaataatatgtgcatttagagatatcaccacaattgactacaaagggaggaagcaaattgttaagttcagcaatggttgatcttacctttggtgaaccagatgcactgtgaatacactgggaggaaatacaactatagtccctgccttcttgaagccccagtttttactccctctttctcatacccaaccattggaactgacactaagagctgtccttgcttcctgaatctccttcctccaatcacagtggctttgcttctcctttctccaaggccagcaactgcaagtcagcccaacctatgcccaaccccagaccctggtccagcccttgtagcccagcttgagcacagccctgggtccttgcttgcctgtgaaagaatattccagcctgtgagctccttgaggttttacgggatttctttcagaggacccagcccagtgctgggtgcaatagatacatattgaactaaaaatagaggctgcctgagcagagggaagacgttatcacagtttcatatttattaggccttttcattttatgattcaccacgtgggacacaggccaacagcccctcttcccttaggaagtggccttctaactcagaatgacacagtattacatattcccaacagggaaccacaaatgcctcacaaatgtttcaggctggctggaagctttatattgagtctcaaggagtgttttctttgcagttttgtctttgaatagctggtgcatgtgaggaagaactatcaggaagggccattattgcgcatgtgctgtgcttcggggaagtgagtgtcaagtctcacccactgatctgggaaagtttccatgaattcattttcctctcacccccagcgatgctctgtttgctaactcaagcaaggggaaaggtctgttttcaattaggacctctcaaaaaagtgtttttaaatggcctgtaaaaataatccaataaaggcctcagaggtgtgagctgttgtcatcatcctgtttggaaaacgtcactcagaatgcaccctaaagtgagggagggaggttgtgatgccttaaaaaaaattaatttgtgaaatgaacctgcaggattagttgtccgcctttgtgcccagctttaatatgtcctcaaccagggaaatccgaggctttggattattagccgggttggatcacgttaccctgtttggctctgcagaaatcacacttttcattttgcctttaatcctaaaggtcaccgggaaggtcagccccaaacacaaatgatactttgtggtcttactttcagacaattatcaactcataaatcttggtcagactgtaatgagagcgcgaggaataattgaattcagtccagactcacagggtcggagggagcagagaactggaaggggaggggacagacagagggagggggttcagggcctgggagccagaaagtcttccctccagcactgcagattttcccatttgtccttgttaaatcactgtgttttgaaatttggatggatatgagtgaagccattaaagatggggatggttcattggtagctcagaaaatagagcgtaagattcttaaaagagcacaagtctaaaggcagcaagttgacaagaaggaaagactagaaaaggagtcaggggactgaggtgctgagtaccccagttcagccagtttccaggctgtgtggccctgggagaaccatttcacctctctgtcctgagaatggggctgctggcccctcccacatcccaagattgtcataaggatcacatgagataataaactgaaaagtttacaaactcacagaaagagacaacattcttaagcacattaactgagcttgattcatcaacaataattttaagaaaatcctgttggctctgtattccaaacatgtctacaccttgcctacttctcaccagctctaccactcccatccaggcccaatccagcattatctttcacctggattattggaatagtactcaaatcagtctttctttccacatatgactcctccataatccagtttcttttaaatgtgtcaggcgattcttctgatcaaaacccttcaatggttccccatttcacagggataaaagcccaatctcaagatcacctacgagacaaccccacagtacctggagcccgttcctgccctgatctcatctcccactgctctgccccttgcccagtctcctccagccacaccagtctctttgttgcccctcgcacctgcagggcacgctcctgcccttagcctggaatgcatttcatgcagactcacacatgacttgctcatcttcctctactctttgctcaggcctcacattgcctgtctgctctatttaaaattgcatcacggccacctaacttacttattatgtttattgtccctcttcctcctattagaatgtatgctccttgaggacaggatttgagcttcttttctttactccagttcttacgagggcctggcgtggagcacacactccgtatttgccaaactggaaagaaaacttgatttctatctggctagagctcttgttgatgtggccatttagatgctgaattgcctaataatgctacctgacttctccaatcatttttccggaaaatcttgcatcaagtttgggtgatttgctggattttatcaatctgtgtgctctccagaacaccatgcaccatatttggtctcagttttattgttctattggctctacttagcacatctggctctgccaagggacacagttgggccagctgtccaacattccagggcaagctacaggagaagggtgtgatggtgggaaaggaaagaaaagaagggcctgtgcaccacttgccatcataaccaacctgcttacacccatgagaatctgctgcaatacataccaaactgtcaacactaataacagaaagggaaggaatcaaatggtctttggcttgaaattacaagcatttttgtttttcaacaccaagcattgtaagttagcatgtatcttacatagtgacagcactttataggtatatacggtttcatttcacccttattccaatagggtaggtgtattggtatctttatactatagacaaggaaacagattacatagtaagtccttggaagggtcatgtctttccattgcaagtgaatttagcttagctggtacaagcaacaaccccaacaaatgtcccctccctcatattctacagtttagaattctgctgcagacagaatgatgtctgtctgttctgcttcctcagcttaccaactagggtgaaggctgtttgagaacagtaaccatgtcatatctccaaggctctggcaaggtttttggcccaaagaagttttgcaattgtgccaggggctacagtaagaagtaaataaaagataagccctatgaagaaaaaaaccaaaaggatgctgagaaagagaatagcttcattgagggtgatctactttggacagagtatccaaggaaggcactcctaaagagttcacaatttaagctgagacctaacacatgactatctgctccctggcagatgaccttggcaggacaaagataactgatagctacctgtcagcttacccgtataggagtgaagattgtgtgcattttgagaacaggactttctgaaaaaggaaatgggcagggggaaaggaatggagctgcacatgcttggtttttcctttcattcaaggaatatgtattgagatctactatgtggctggctgctctaggcactaagactatgaccgaaactcatggtgcatatatttaacaaaggagagagacatagtccattaaacatgtaagatgctggtgatagctcctacaaatataaactaaacaggataagaagggatagagaatgacagaggtgggagtagggagaaagggtaactgttagatagagtcagggaaggccatactcaggaagtcacatttctacagaagcccaaatgtagagagggaatgagccatgccaagttttcaggagaagaggtggttagaaaatattttagcagaagcaacagaaaatgcaaagagtctgagaaaaaatcctcttgcaatttaagaagcattcaaagaatattaagggtgagcaggggaagactaaaaggaaaagaggtgggaggcgtggccaggagcaagatcacaaagagccttatccctggttaggaatttggattttattctgtgcaatgaagtcattgcctggttttgagcaagagagtgttgtaacctgatttatgtttgaacagtattgttttggcttctgtgtagtgaaagaattgcaggagacaagagtggagctaacggcagtggcccaggtgagagatgatggcaggaaagtccttggaccaggggcaagtggaggtggaaggaggtggacagctgtgtgatttttttttataaagagttcacaaaatgtacatataattcaaagtagtggatgaggaagagagagaaatcagagacactaatagatctgggacctgagcaactgagtggatgttggtgccacttccttgccttcctagaggaggctcgggatttggagagcaacatgttaggcttggtggagagaagcaagctgaaaacagcatgccctcttccttctcttgatctctccaatcaggtcagtatctctttgggagggaagacaagaaatggggatcccatactgtcttcatccatctgctatacaaaaaaaacataaactgggtggcttatgaacaacagaaatttattcctcatggttctggagtctggaaagtccaaaatcaaggtgccagcagatttggtgtctggtgagagcgcacctcctggttcacagagggcaccttctcactgagtcgtcacacgatagaagggaaaagagcttcctccaagcctcttgtatacaggcactaatcccattcatcagggctccaccctcatgacctaatcatctcctaaaggccctgccccctgataccatgaccttgaggtttaggatttcaacatatgaattttgggggaaaacaaacagaccacataacacataccttctcctcctagaaaaatgagggcaatttttatcacagaaatataaggaggttataaaggcttaccctaaaacttagattttattttcatttttattcacctggggaaaggagcagtacagagaaaattagggaagaaacagaaaaatatgtaaacaattactacaagccaaactactataggtgctagaagaactgtttcttaatatctctgcatctcagtaactattactgtgtctggcacaaaaatatttcttgaactgaactgtcataagatataattctgaatgaggggatcaaggaagtcttaggaaaggaggatttagagtcttaacttggaattttctctgtttgctgtttctattcatagtattactcacacagtcccttggtatggccttggtactgtaaaaacctacttcaacaagcctaggctctgcccagagaccttggaatctgagagtgttttagcccagaataggtggaaacctcaggcaaagtttataaaaattaataccactgcagaaagtgattaaatacatggactgtaggtttaggtttctgctccaccacttacttgctgtgtgtccttgggcaagttacttaacttctctgtacttcaatttcctcagtgcataatggagattttaatagtagccatctcataaggtggttgcaaaggttaaatgtgttaatatgcatgatgcacatagaacaatgcctagcacatagtagagatacataatcactactactactgctaccagtacaacagcaggtcttatggacctaaggtcatataacttagtctcttccaagattcttgaaatgatttctcaaaacaagagaatataaagaagaaacgttatgaacaaatggtaaataagaataaatgttagtaataaatggtaaaaaaaaaaaaaaaaggatatgaaagccaatagttacatgttctttcctgttaaagctattttacaaatggaaggaagcaaatttactttttcctcttgaacccgtgaactttgaaaatcttctcatctatttgactgagtagtatggtcttttaaatggtatataagataagaagtattcaaaataaagatatagcctttataaaattaatgccttacagacgataacaaacgttggtgagaatgtggagaaaccagaaccctcatatattactgatgggaatataaaatggttcagccactttggaaaacagtttggctgttcctcaacaagttaacattgaggtaccatatgcccagcaattccacttctaggtatatacccaaaagaatttaaaacacatactcagccaggcacggtggctcatgcctgtaatcccagcactttgggaggctgaggcaggtggatcacctgaggtcaagagtttgaggccagcctggccaacatggcaaaaccctgtctctactaaaaatacaaaaattagcccggtgtggtggcgcgtgcctgtaatcccagctattcggggggctgaggcacgagaagcccttggacccaggaggcagaggttgcagtgagttgagatcgcgccactgcactccagcctgggtgacagagtgggactgtgtctcaaaaaaaaaaaaaaaaaaaaacacatactcatattaaaaaaaatgtgtgaatgttcattgcagtattattcataataaccaaaaagtggaaacgacccaaatgtccatcagctggtgagtggatagacaaaaatgatatgcatacaatggaagattattcagccagaaaaagaactgacgtgctgacacatgctacaatgtagataaaccttgaacagttgtgccaaatgaacgaagccagtcacaaatgattctacctatatacaatgtccagaatagacaaatctacagagacagaaagtagattcgtcactgtcaaaatctgagaatgacgactaatagttacaggttttctttgggaggtgataaaaatgttctagaattcgatactggtaatagttgcatgaccttgaagagatacagaaaatcaccaaattatacattttaaaaggcaaaatttggccaagcatggtggcacatgcctgtagtccttgctactcaggaggttgaggcaggggtatcatttgaacccacaaattcagggccagcctgggcaacatagtgggaacccatctcaaaaaaaaaaaaaaggcatcaaaggctaaattttatggtatgtgagttatatctccaaaaaaaacagaatagtacatcatgtttctgtctgtgaagtctttttgtatacgttttatacgtagtcctctcccaataccccagagagatgcaggctgagagtcttatgaagtttgctcttactgatcaggtgtggcgtatgtaatccccactctaaagatgaagaaatttaggctcagagaggttacacgacttactcaaagttgtgcagctacggcaaaaaccgcaattacctttgcaccaacttaataatatgagctatatctggaaatggatccagtgttctttctcaaagaaataggcagtacaagggggtccagatagcctatgaaagtgcttaatttgggcactaaagaatgcagcatagcacactgaaaaaagcatgggctttggagtagcctgacagactttgattcaaatcccagagccccactcatcaactgcttcaccttgggctagttactaattccccctagacctccgcttcctctttatgaaataggaatgttatcgcctaatctggatggatgtggggttatttaacaaaatatatatgtaaagtacctgacacaaagaacatgctcaatgaatgtactgtgatgttgttatgaaaaatgaggatagggtcatagattcaagagtatcataggtcaccagactccgcactgctccaaggacttggcctataccctccatccagctgttgatgggaatcagtacaacacactggagaagaattgggagtaggggctgaggagacaggttctaacttgggctttgctactaacttagtctgtgacctcgagcaatttacgtttttgctcgtgtttcagttacctgtacgttagatagcagttttaaaaaaaaaaaaaaaaaaaaaaaaaaaaaagctacatgggggctcatgtttgtaatctcagcactttgggaggctgaggtgtgaagattgcttcagcccaggagttcaagactagcctggccacagagtgagaccccatctctacaaaaagaaaaaaaatagccacacatggtggcatgcacctgtagttccagctacttgggaggcggaggtaggaggatcacttgagccccggtggtggaggctgaggtacgctatgattctgccactgcaatctagcttgggcaacagagcaaggccctgcctcacaaaaaaagaaaaaaaaaaaaaaggttattttcctacctctcaggattatcagaatcaaatgaaatcaagtatctgagctgactttgcaaagttgatatagggatttgttaactacaaactaaatgtgcccttgatggaaaaggaaccttatggaatgatgacagttaacatttgtagagagcttactctgtgtccagcattgctctaaaagctttccatgaattaactggctcacctgagacatacaacaatctttggaagctaatgttcttaacatctggtttttgtttttttgtttgtttggttggttgttttttttgagacagagtcttgctctgtcaccaggctggaatgcagtggcgcgatctcggctcactgcaacctctgccccctgggttcaactgattctcctgcctcagcctcccgagtagctgggacaacaggcgtgagccaccatgcctggctaatttttgtatttttagtagagacggggtttcaccatgttggccaggctgatctcgatctcttgccctcgtgatctgccagcctcggcctcccaaagtgctgggattacaggcatgagccaccacacccggctaatatctgtttttaggtgctgagcacaaggagattaagtaatttcccaagaccacacaactagtaagaggaatgaggactcagacctaagtctcctggcaccaaagcacttgacctctagtgatgttcagtgtatctccattttcagacaaggaagttcgtgagactgtatccataaggcaaggtgaggcaactaacaagtagtatgagctcaccacatgccaaaccattcctggtgcttcctctatgccttcctattcctcatgacaatcctatgaggcagatgccatacgtattttactgctggggaagctcaaagcacataattgacataattaacttacctgaagtcaccagcttagtacgtaataatgctaagatgtgagaccagttctttctgatgcaaaggcccctgtactttccacatattctgcctgggtggaatttaccctgatgccaaacataatacacacgcacaaagtaatgctgtggcatgctttgtcgatgggcccaaaatctagatataagtggagcagcacattttatgtctctcaggccagagatactgctacactggcaagcacttctttaagctcctgagctgtgacaggaccgtgatatgatgagttacacatcacaggaagacaaagtccttaatgataatgctggcagagtctgccctggtggaactaggagcaggtggtgtggaaattaaaaagtaactggaaagcagaagaaattgtggcattcttcattaggactgataggcaatttttggttcactcccatggaaatcacttgcggataaccaggcagttattaaacatacaaggcttgtggaaagacccattcattactgagtccctgcaccagagtttctgattagcaaacattgacatcacagagcctggcacaagaggccaccataaatcctgtcacttagcaataggataagtaaggcagcacctttggaaggacacaatagaaccgcagatgtagcacacaggtgtttggaaatatatcaatattgaaaatagggccaggcgcagtggctcacgcctataatctcagcactttgggaggctgaggagggcggatcatgaagtcaggagatcgagaccaccctgaccaacatggtgaaacctcgtctctactaaaaatacaaaaattagctgggcgtggtggcaggcacctgtagttccagctacttaggaggctgaggcaggagaatcgcttgaacccaggaggtggagattgtggtgagccgagatcgtgccactgcactccagcctggtgacaaagcaagactctgtctcaaaaaaaaaaaaaaaaaaaaaagactgaagtgactaagttgcttgtattttccagaaataaacatttcccataatgaaattccaaaccttagaccctgtagtggaagccacaaggccaagacaccactcccttagacacccctgtgatcttcagggcctctcctttggtctcctggtcacgtcacactcatgcaaaatctgtcagggacactgaaaggttttatactcaggtgtcttgcccatctcaggcgatggtaacccatcagggttatggcacaggccataaacctgggagtcacccttgactccctctctgttctctctgttctcacagtccacattaatacaacaggaaattctatctctatctcctaaatatctctatctcctaaatatccccagaatccaaccatgtccactactcccatccttatccaagctgccgtcctctctcatctggattaggcgactgcctctgaattaggctcctgctttcattcttgccacactactgtttttttcaacactgcagctgtcatgatcctattgaaatgtcaatcaaatcatgtcatgtctatacttaaaacctccaatggttggttctctatctcagtaaaagtaccagatcaagtccttacactaatctttattagaaaggtaacaaagagcacaccgtaagggcactgtaggtcagtgtcaggacttgaccttgtgctattttaactcttcccctcccactctctctgtgccagccccactggcttccttgctaaccctcagacagcccagaagtactggtatgagagcccaccagagttgccaggctgggggaaggactatgatggagcggggcacctgacccagctcccgggtgtccaatctagtgggtggagcacagttcctctggagtagatggagagcaatggtacagggcctttggtgaaagcagaaaaattgggcacaaattgcatgtcgcagtaagctgtggacagcctgagtggagtgggcaatctgaaaaggtgacttgaacatgatgagcatgccgctgtttaaaatcttctactggttttccatcacctacaaaacaaacttctgattctgtaactcagtgcacaaggcccatccttttctctcatctcccctgcagctctggccaccacgccctcctatgtcccctcctttgtctccttattctagccataccaggttgctaaaatttacccaagccggccacactgttccaaacttgaggaccttcgcttttgccatttcttctgtacaaacactgatcccttctccttcttcacccactccctcaatattcaaaactcacctatggcaaggctgaacctttctccaccaccccatgcctccctccctcacaatacacatacatgcacacacacctgcacacaccccatctgatttaagatcgtcctcctctctgctccaatagtgctgcgtgttcacaactgtcatgccactccatccattgtgctgtaattgctgatttgtttcctcccagtggatcatgagttcttttttgaaagggactgattcttgtgggtctctgtatcctcagcatctaacacagtacctggcacatgataagtgttctcttggctccatacatgtgcatcaaatgagtgaagatataaaagcaggtgttccgtcaacatggcaggtttgacagcaagccacatgcacaggcctggaggtctgagccaaacctccagcacttgggagcctggagaaagcaaaacaggggttggtcttgcaggaaataggacatggacaggtcatcaaattgaactattaaggacaagggggaagtcaaggactcagatacaagaactggaagataagaggtgggcaagacagaagattccaagacaggaatgatttctaaaggctgaaggagttattgagccaggaggaaagttaatggatggaaaggaaaccaaatccccctgttaaagagaacagagtgcagggagcctggttgtccataacactgtgcattttcaacagtatcctggtcagccgtcatccccaccacactgaaatggacctcctgcaggcaagactgacagggccatcacttggcagaagctaaaataagtaggtttattcccacatttacccttaaagctttctccctctttttatcactttcttttcaaaaagaacaagaagagattcactcaccacattcacatttagcaagacacgctctggagtcacattgcttgaacttaaatcccagctgtgccacttactacctacctgacttctaccagtcctatcctcttgtaagcctcagctttctcatctacaaaatggacatgaaaataatagtaactacctcacagggtgaatgtccattgctactgtctttggggttgttattattatttatggcatagcaatcatgaacacagacagtagagccagactgtcaggttcaaattctgtctccatttctcagtggctctgtgaccttggcaaagttgcttacacctcagtgtcctcatctgtaagatgaagataatagcctgacttcagaggggtcttaggaaaagtagagactagcctaagaattcctgggttgtaataaatgctatctaaatatttgtggaataaatacatcattgttattatcaagaaaccaatgacttatagagccccccttctgctgtgcattttgaaaggcccaacaagggagtgatttttgccccagtggcataacactaacggtcaggggcaaaggtgatattggggtttcctgatatctccaaaatagtaccctataagaaccagccctttctctctgctgtacttctggctttgcaggacccaaaccagccccttgcttgctgaaaaggtccccagcattctgacaacatataacaaaggtgtgggagggagtggggccacgctgaaaacagctgacccagtggactggctgctgccactggatctatttcccagtgtctcggaagttgctgacttcagcctttccagagtaaagcaccgtccatggtcagagacagcaccaaagcagcacgcagcacagccgtaaatctatgagccatattatttaagagacctgacttcttgtgttgcgatattaaagcaaatctgcctcctgctcataaatcagcagggctatttccatcctcagccactcggcttcagccatcttgagatgcacatggcatatatagttcactggcttaggaggtgtgggttgagaaagtaaaggaagagatgtatctgtctcctcccaaaactctgttttcatgaccctgcctgcatgttccttccccgtcccatgaccttagattcccagagtcctctgggagctctaaaaaatacaacatgaacacctgatattgatacagtgagttaccctttatagcactctgagtagatagggtaggcattgttaatctcagtttagagttcatgaaaccaaatatcaaagatattaagtgaatttcccaagatcacgcagctagtaagcaggggagcttggattaacccaagtctcttaattcctgatccagtgctcttttcatagcactaagtctctgttatcattaatttcttcacttgcataaagccaagatatgccaggtcactcctgaaaaaaaaatgacctcagctcaaaaattttaaatgaacattgcttagagcctgctgtgtggcaggtgctttccaatacatcagcaaatttcatcactacatcaaacccttccgtggcttcccttcaccaagagtgaaatccaagttcttagcttaatatacaagggtccttgtgatcttggccctgcctgcactttggcctcatctccttctaatacaaatcacagccctcgcttcatcttttcattctccaagaagtctgccctgagcctcctctcaccctctgtctgggttgaggctccttttctgtattcctctaacacccggcagttatccttacttgcagtactttctgtactaccttaccctggtctgtttactcatctgtgtactctttttttttttttttttttaagacagggtcttggtctatcaggctagagtacagtggcacaatcatggctcactgcagcattgacctcctgggctcaagcaatccacccacctcagcctcccaaagtgctagggttataggtgtgagccactgagcctggcctctgtctactctttagactgtgaactccttaaaggcagagatgtagcacagttctgggtacaatagtaggtgctcaataaatgttcctgggctgaattgtcactgccattctatacagtaagcattgttatcttcattttataaatgaggaaatggaagttcagacacaggaagtaagctgtcaccatcagtcctttaggaaggtcccagctaggaccagcactcagggttccagctgctgtgctatagcccgtgccctcatggcctgcctctccctgtcttattcatcttagacacttctgcttttccagcctaagctaacacactgaattagccctgccattcagcaccatccaaggcaaaagggagaaagagggcgtcgccagcatcccagccccctctagtcagtatgcttcaaccacctcttgagaaaggacccttgtgggccaccctggaaggaatattgtcctgagcactccctgcaaagccagaagtacagcagagagaaagggctgaccagaaccaatgggtgaaaaccagagggcaggctatttctactaactcacaagcattgagtgtttactctgtgccaagcatttcccaataactagatctgtcagaaaaaggaatggactcttagccatgcctggagggggtcttccagaggcaggaatgttgcaagcagagacaggtacagagttgccttggatgactactacggtctctgaatttgaagccctgagcccacagctctttctgggtccctctttctccccctctccctccctcagcccctttccaactcttctaagcactataaaaagcaaaaggctttggaaatgtaactaaagtagttttatgatggattccaaaacattactttaagtacggctctaagtgattttgtttccaatacttgctggcagaaaaatattacccctgcatttcaatgcagaagaaataagcaggctgcatttggccaaattcatttatttcagttatttcctaaaatgagtgtaatttggaaatcactagtattattttctcccagtgcaggttaatgccttatacatagcccttggaagggacacttcttgcagagagagagttattagctttttatttagaatgtactgtataggtgatttgtgggggtaacaaacctaaataatttaaagtagtctttatttgctgagaactgcaggtttttttaaagtatattttaaatctttaaactttcagagattaagagagattggccagggatttatttggagcaggaatttctttttcttgtgcttgcgtctttcccagcatccattcttttttgtgcctccatctagaatcatgtaatgtcagcgctagaagagaccaaagacagccatcctttacagcagtagttttcagatttcttttacagccaaatcctttatgcaaaaaaaaaaaaaaaaaaaagtgccactagcaataaaacagggaaaaccagagttacagctgtcctggttggggcttctttgtcccctcacctctcttcactctcatgcaaatgcctcacagaacccctgaagaacacactttgaaaaccaaagaccactctctttaccataacagaactgaggccagaggatgaggcatcacttacccaaggtcactcagcaagtgtaaagcagagacagccagtactagaatctcctgactctgaacctgtgtgcatcccactagctccagctgcttcttgcgcttggctttcccattttaatatagatctaacaaccatctttcaaattcccgtctctgggatcttgcaaagaggaagccctgcccaaaagcacagcacagactcacactcattcatattagcggcaataaggatgcttgactgagaccacaagctttgggcagggactctttacgatgtgcctgtcactcagaagccatcctccagcagggcttggtgagcttgtcatttctaagcaaggcacgtttttctgcggtcccctttccaaagagcaagtggtgacagccgcctggaatgcagagtcagcaaaagggaagccactttgcctgcaaatgccctgcagagaccctgccccctttgtccctcgtcatcatgcttgcaagcccaggccttttttcctgggaaccaggacaccctgtgctagttaatgtccaccacaggtcttttctcatgttccataatccacactgattccatatgtaaccaagggcaatttttgcttgtttatgtgctttctatttctaaggaggggagcgtcttgttacatgaaaggcctgttgtcctgctaaagaccttgatgggtttaggtctgagtttagaaagtaaaagcttaagagctcatttcccctgcatgaggaaatgacacaaacttatggggttttttgttttgtttttatttgctagaggtgacagagtggacaggagaggggacaggaaagaggacaggaaagagatagggggtaagttctgccacatggcaggagactggagtccaatttgtcaaactggctaaagagatttcagaaacaaaaatccctaatgtgaaattttcaagttttctgtgttactgcaatcaaaattcctcccattctatgtgcctgaaagcctagttacaagtggttttcctgataaaattaggagaaagggttgggttcacacctgagttgatgtggtaaggtaccagacacatcaaggcatgagaaaatccataaaggcagggtgattaaactaagagtagagctcaaagccagaggtgacccagagaacagaagacacagggtaagattccaccatcttggggaggttttagtacttgtacagtcgttgaaatgggggtttgaattttgtcttgtttccattaatgggtgggagagacaccatctgatgtcctttttttttttttctttttttttgagacagagtctttctctgtcaccaggctggagtgcagtggcatgatcttggctcactgtaacctccgcctcccgggttcaagccattctcctggctcagcctccccagtagctgggattacaggcgcccaccaccacgcccagataatgtttgtatttttagtaaagacagggtttcaccatgttggcgaggatagtcttgatctcctgacctcgtgatccacccgccttggcctcccaaagtactgggattacaggcatgagccactgcgcccagctgatgtccattttatatatactctagccagaacatctaacgctgtaaaaacacagattttgccagccctgtcagagaattcagtgagttaagatacttcaaactggtaacatttgctgactgtaactacaaactagacacactgacagtaactttcttacagttgtgtttgccagggtttgaatactaccagaaatcctttttaagtctgaactccccaagttctcaccaggccacacgtgattggtgaggtcatggggtcaagaggagaatgattgtttcactccaaagcagaaagcataaaagactctcagaataattagcctttttgttacgactaatgaccaagaacagcaataacaaacattcccattctttgcaaaagattatctgaggtgttgaaaagtcctagagacagacataggttaatgctgaatgggaggtctaaattaggtccaaaccagaggataaggtagaatttgaagaatttgcacacccagcaattttgggaaacagagaaagggccctggtgttaatctccaatgttctcaaaattgagaaagaaaaggcttccttgtgggtccgggggaacccatcaaggtagaagtgaggaggggttaaggggggtggggggctgcgatgagggcaagggtggtacatatcttcaggggagagtaaaggaataagcatgtctaaccaatgcaggcaaggtccaaaatggtggctagcttggaacattccagtcttcatcccttcattgcgcaaggtcccttccaatacccaacccagatttgctttccattatgtcatctctgtaatttgccacatctcccctagacaggcagcctagggaagaggccagagtgatccccatgagtccagagtcacaggttcaagcctcaactctgcccttctgtggttgtaaagtcaagaataggtcattcagctacccaagcttcagctggtacattagcaaacagtgaggtttcaaaaggtttgttttatagcagaacactttcttaaagtaaaatcttattcagaagcccaatatacaaaataagtcaaagcagacttggctaggctaaagcgaaggtaatcgtgatggtggcagttcctaagttgcccacagacacagagtgccacagggacatcattccttcacatagaatcccatgtgagtggcagccctggatttgtgcaaattaccttcactttagtctagccaagtctgctttgacttcatttacatattgggcttctgaataagattttacctaaagaaaggaagaaagaaggccaatgcagctggggtgaggcagaggggcggggggaagaatgacagtgagagacgcatcagatgaggttagagagggggcaggcagggaccagaccaagcttttatgtctaagctaaatcttatatagaattcaggaacttttgcttcccattttcttcttattagtgagtatattttctttctttgggatactagtcagagtgagaaataaaattaccaaaatattgaggcacactggccagcctgactaagaacagccccaggctagggaatatatctaagtccagagcagtgggcacacccagggcctggcacactgggaggctgcagaagcatttgttgcataaatgaatgactggaagaacaaatgaatgattttaagtttaatcattaatttatcaataattccacccacagagctggatactaatttagaaggccctcagtgttgggctagacctcctgctagatcccatcatcaatcccttctaccctgcctgcctacgatctccactctctattccaattcctcctctgatgggcatctttttgcctgtcagtgtataacataacattatataacaactataaatgtaagccaaaatttacctctctgaagcatctattcatgaatcctttttctaatcctttgaggacagcacagattaagtctatttccttttacagatgagagtctgtcagaaatttcttaccttcatttgctccatagaaatcatgtttcagttttagactggaaaatcggagttctgttcccagtgattctcagtgagcattctaacatcctaggtttatggcactaaacacagcccttgaaggtggtgtctacatttccttgtaatctgttttaggtattcatatagggagttcagtaacataagcatcaggacctttggcaactagggctaaagtttgagctcgatttgaagtctcttgagatatgtcggacagtttaaactccaacacttgtgaatattagtttgcacatttttcgtagtccaatggtctagggcattccaggatattccaccatgccaaggtaatggattagttcgcacagtaaaactatcatgactaattcaacccaactggagaacattatttgaggggagggggtgcagggtagcagaggttacttaaagcattttgggtatttttttttttttgagaaaggaaacttgcatgaagattgaatgatttattaacccccagagaaggtgttacatataggtcaagtccgagttcattttccaggcaaggcagcagtggtgaaggcttctggttacaaagtcatcttattttagtgtttataacaatagggctaaggagaacattcaaagtattcaaataatttaataaggctcatttttattatattgctcttcctgatagggccatgatctttatctttaatttttttttttttttaaatcaccaaccactccacagaactttgagaccaatttcttgccctgattgccagaagggccattttcctcattctctcaagggaacatatgtagcaggagaaggaagagtccatgaccccttgagcctttggtcagtgcagcaacgccatggcagtaatctctgggccaccatttggcttaatgaatccgcttgactttaattctagcccagatgtaatcttttatagcttgatgatttgttctcccaggcactctgatgaaatgctataaactgttcgctagaatccagtgaaaatagtttttattcctcatttctgtttctaattgttgagcaattagattgattcttgatctcttacaatcaccataaaattgtactatggcaaagattcttaatcatgatctgcatcaccctacaaatagaaaacactgaaacattttgagaaaaaaaagaactttcttaattcatttaattagaaaacataaaaatacaagaagaagaaataaggggtattggtcaaagggtataaaattttagttatgcaagacaatttctggagatctaacgtaaagcataatgaaaatagttaatgatactgtgttatatgcttataatttgctgagaacatagatcttaaatcttctcaatacacacacgcacacacacaacacaaaacggtaactatgtaaaggtaatggatgtgttaattaacattactgtggtaataatttcatgatgtatatcaaaacgtgaagttgtacaccttaaatatacataatttttatatgtcaatgatatctcaataaggctgttagaaataaaaatttaaaagtaaaaatataatattattttttaccacaatgatgcctattgtctgaattaattaggtttcctgcaccccagtgaatgagacagatacagaaacacagacacagaaagatgccgaggttaagtgactaactcgaggctagagataggaagccatggcagagctcttcaggagacccctcttggtagctatcatagcccagagccaacagtcacaatctaaattaaacacccctaacccaagagagtcacagagatgccatgatcataccagaaaaattacaacaagcagggcttgccttacaactctgaatgcatgtcaaaaaaagaaaaaaaaggtacactatttttaccctccgtttcctcacttggaaaaattacggcagtgccatttctaattcagcgttatgctgggaaggttgtaaattaattacaattatgccttctttgtgccaagtgataatttactgcaattaattatcaaaagatctactgctgtcaattatgatacttgctcttgaggggggaggagctatttgtgagcatctgaaatctgtaacaaagttatgttttgccttttccccctatttccaattaagctattataatttgttttcattatgccaaacacaatggagaagctaacaatgttactctaaccttttccttaatccaaacattatctagactttcattgagtcaacactcctattgttacacctgcaagttgtacatagagggaggcatacttcagaattaatgagtgcagctgtggtctctcttacattcagcacttgtaaaatagacctctttaaagtgccattatcacaatattgatagagttatttatagcactgcaaacgcatccagtcataacagaggacttgttatccacagcgagttcatgttgctgtcatcccctggacttcatccagcgcccaggagtaggcaccaggtggaccatctttcaaaaatgagcgctaaaagacaaccgaaaactttttctcgaagtgaatctggtagccaggagtctatttagtggatgagtacctgtaagaaacatagcaagtcagcctgagcccagataccatgaacgctggcccatggtagcagggcaggctattcaggtatatacgggatgtcacccacgagctgaccctacatggttctgctggaaagttggaaactccaggtgcaaggctggtgctatttcttcataagcaattcgaagagatgtcgtgcagaagggcaacatcaggaggaattacccttgcttacactcttccactccacagaggatgctttgctcctctttactgtgtgggaacaccttatatgcatcttttccctcattaaattttaagctcattgtggttaaagagtataccttatctgtttctttattagcccagtgctggacacatgatcagcattctgtaaatttaagaattctttgccatgtgctaatcgagtgctaagcacagcactaggtcctataaaacaaaaacataagtgagtcatcatttcttctcttaagaatgtcacagtctaggacaaggttctgtgcccttttttggagtcatgagatcttttgttaatctgctaaggtaaacactttgagacctctttccatagaaaaaaagcgacttcatgtcagtagaatagaacccaagtctctactccagggtcagagctcttgcaacagaagtggcctcagaagccatctgtcagacaagggtgagggtgctgaatgcagacatcatgcacatccagactttttttggacagtgagggtgacaatccctccagctgcccctgaatgcagctggtagggatgagggagaggactgtcagtgtcttataaggactctgcaaagtagggaccctctgagaaaagtgacaggctcctctgcagcaaatggtctgattttctgtcacctttcaggatgccaggtaggtgggaaatctccagatttgcccaattttagggagtcataaacctgtgaacctcacccagagaaccccccaacccccatagctagtggcgatgaaggggccagttgagaaagtagtgtgttgggagaatgtaaaagtcccaagagcagagcatgccttggcttgcggggaaaaggcagtttatcagctcaccttcctctcagatgtctgttcttcccaaaattgttggcctgccttcttcccatacttggggccagccggtcattgtatatttttgtaaatttaggtttaagtttggggatttgatttctttttcccacctggattcctatcatgttcaccccacctcccccagtcccactccttgggagtgtggaagacgaacacatgcagaccaaacttgccaagcaaataggtcagagcctttgccagcccccacctcagggcccagggataacagaaagccagctgagagggcgagataagccctaatgcataatcttccccacccatccacatctgagtttgcaaataggcattccaaagtgaccctggctcagagggttttcaaagtgatgaattctccctcagccacactctgccctgcctttcattccatggtcacccagctatctctaacctgcaatgggcagcctacagggagaaaggggatgtgaccatcctatgcagagaaatctgtcatttatcttcagtgtaaggccaaacaattgcatagtttgcaaagaacctgacataagtcacccaggttttcccccaaaccccactgcttgcatttactggcatcagaggagatttttttcctggcagaaggcagctctggctgccgcctgggcacactgtgttcatgaagtacttctctgcttctttctatgacaggagcacctgtcatggagagagctagagcagggggacactggcatgctagtcctaactctgctgtatcacacagaacattttcctccaagccttgacttctttgtctgaaacataaaatggttagcctagatcaaaggctgcaacctcaaatgccctctgggatcagacatgtaacatatatggcaatgtcagccaacagagtgttcagaactttatgaacagaagaaagcctttagccccacctaaagacatttttattctcaaatgttaaaatgtgcttgaacagcaaaatgtgtctgtaatctcaattcatcccatgactgctagttgtgagcctggccatggatcacagtactaaggcaaaatggcactgttggtatttcagtacttcttttacccagaggcctttaaaaacaatatttagaacgttttaaataaaattagtgaaattaaatgtatttcctatttgaaatttagctgagcattctttggccacaaccggttctgctgctgactttgacatcagtgccttctgcctggggcacctcagagcaactaactgtgtgatggagccagtccaggtgggatttgaacactcctgcagctttcaggaccccctcctctgggcagctcctctactctgaccggaagctctttcattgcagcagttttaatttctctcccatcttcccaggatggatggccctgtctgcagcctaaccttcctctgcttgtgtaggaacagaaggtaggcagaagtgctgagtttcattcaaagctggctttccttagtaaaaagtgttggtgatattattcaatttctaccattcccgtggccagcctctgtgcctggggtgaggggagaagatggagggagagaggtgctcaaaggggatgggagaggagagggcaggagagttgcaggcagctcttctgctctgtgttcctctagcagcaactatacttacctctgtcactacacttttcattttgcattattatttttgttgtttattggttattttattgcttacatgtcccattagaactgcaagcaccttgaagatatatttgtgtccccagtatctagcacaatatctgacacatggtagacacaccttttctttttttttttttttttttttgagacagagtctcactctgtcacccaggctggagtgcagtggcagggtccaagcccactgcaacctctgcctccggggttcaagcaattctcctgcctcagcctcccgagtagctgggattataggcatgtgccacgacgcccagataatttttgtatttcaccatgttgggcaggctgcttcaccatgttgagacagggtttcactatgtcgtatttcactatgttggccaggctgatcatgaactccacccaccttagcctcccaaagtgctaggattacaggcatgagccaccacacccagccaaggtagacatgacatattttttatacaaaatgcattactccttacctcttgtttgttgcaaggatgttgaatgcatgtaaacaaaataaagaggagaaggcattctgggcttggggggagcataatcataataaatgtaatttataattagatagatatagatgtagatatttgtgtttgatgtctatcttttctactccagtacattgccagcacctagcacagtccctcacatatagtacatactgaatgaatattttcaaaatgaatgaatgagaggagaaagagcattttgcaggatttccatttctttcaacctaccctgacagatggctttagctcccctgctttctcaaacttacctaccagattctcccctcttaagtaatagattgatacttccttgtatctttgtgttcactgagggtctagaagtcttgaaggaaaaccccatgcagagtttatgtacatacatgataagccagactgacagttctatcagaacggcctttttcataatttaattaaactctcttaaatgtagacatcagtcaaggacaactttactgattgtgtctaattgcacatattttcttacacttttactgaagcctatttttcaagttgcttgaaagactgctcctatttctgaaaggggatatgccaaagcagggttttaattcattgccttttggacacaccgtcattccctagctagcaccaatctgctacaaaatgtgattgtgtgattacttataggagtctcaagccacctttttacaagagttggctggttaactactagaaaattcagaaaacctgtctgcctttcattcatttagtcaatcagcaaacatttattgagtccctattatgtgctagaaatgcttattgagtccctattatgttcattcagttagtcaatcagcaaatactctgtctagaatgatatgattcatcaagatcggcttcagatcttccccaagggcaggctttgagagtaagtgggattggtgagaatggtggatttcagccttgaacgtgacatgcgggcagctggcgtgtgtagagaaagaaagctacttgtgggatcgttttctattgctgctaagacaaattaccaaaaacttgatagcttaaaataacacaactttatcatcttacccttctgtaggctagaaatctaacatgggtctcaccggccaaggtgttggcacggctgtagccctttctagagtctctagaagagaatctgattcccagccttttccagtgtctggagaccacccatagcccttgattcatgatcccttccccatcctcaaagccagcaacggtgcttctctctaaccattcttctctcgtcacatctccctctctgacctttctgcctccttctttcccttttaaggacacttttgattgctttggacccagctgcataatcgaagatcctctcctttaattccatttgcaaagttaatccccctttgccacgtaaggtaacatactcacaggttccagggattgtggcatagacatctctgaggaaggggcattattctgccaccacatggaagaagggtgcatgatgagacagcgctggggcattttgagaaggaggtatcatggcatgatgggaagatccttttccactataaacctgggctcaaatcacagctcattcctgtactaacccgtgaatttgaacaagtcatttgacatctctaatcctcagtgtcttcatctaaaaggtgtagataacaataattccttcccagaaaatgtgagggaataaaatgttttttaaagttaatgaagcagtgcttggccaagaataggtactcagtgaatgaggaggaacagtaagaaatatgttttggctggaccattaagggccagcaaaggagcaaaaggaaataggaatggaaagatgcacagcaataacatagtgaagaatcttgaatgccaaattttattttacagaccatgaaatgttatcaaaggcactaactagaacaagtgagtggcctgagcattcaccaagcaaaaacaaacgtcagatgaattaaaatgagtagctttggcattaagattccctaaggacaggtaggctaggccccctcacatctaaatttcacattttaagccaataagtagaaaataaatcccccaattctgttgctgccagtggtgaacagcatgttgtcctctaagcactcagttcatgttcacacataattttaattctgctttaacttcagattcatggattttcaatttatccaacatctggaacaccaagggcactgggaaagccattctgggaggctgccacttacacagtgggacctcaataaacatttgttgatcaaaaacccaaaacatggggaaaaggaagatttggaaactgaaaccaggtcttttgaagtggaacataatttgaagggtttaactgtgatatattgaaaaacatattttgcaagtgaacaattggtgaaaattatcagctaaggttagcaaaagatccaggggaggaaagaaggaagtctagagtcttcatgcatgtgaaagggacattttggaattactttcatttttgtcacaatcacacacatacatacacaattaggcaattcctaattacaagcatcaaaaaataacgtcaaataattcaagaagattctttttaactcctatgattattatgccatcaactattcctaactagtatttgttagtcaacaaaggagaagttgttttgtaaaatttttctgcaatccacaaaatgtatttggtttggtatttctggttaattagttagttctatgtaaattgatacatttctggtaataaaaagaatatttcaaaaataacttcttccctggatgacagaacaacaaataaacactgtgccttttttttttttttttttttttgagactgagtttcgcttttgtttcccaggctggagtgcaatgtcacaatcgtggctcaccacaacctcagcctcctgcgttcaagcagttctcctgcctgagcatcccgagtagctgggattacaggcatgtgccaccaagcctggctgaattttgtatttttagtagaaatggggtttctccatattggtcaggctggtctcgaactcccgacctcaggtgatccgcccaccttggcctcccaaagtgctggggttacaagcatgagccaccgtgcccagcccaacactgtgcttcttgcactgatttctgccaataatatgaattattttagggcatgtatagtgggttccacatgtgttgaatttaaccccctgatttagaatgcttgtcagagacttctttgcagaccacaatgtcattgtgtctccaggtttcttttaaaatttacatttgctcctgaggaaagggcaaggtaagcagaactaaactaatatttgtagaacttctctctgcactggcccttcaaggatatcatctcactcaatcctcattgcaaactagtgaaggagctattataattctcattttatgagtgaaagtgtgaaccccaaagagttttataccttgcctaaagtctttcaaccagtaagtggcagaaccaggatttgaacctagttttctcagtcatccatggctctagtttaacttctagctgtcaaaacaattgaaaaggatccaccaagataaaacagaagtcactgatgaactagaacaggtgctgaagctataagatggagcctgagagtcagccttactctttgacttatgttaaagaaacatcactgaacaatgaatttctagttcactcatctttaggaagaaaccaagaaagatttcagtcaatcaataaatacctagatgcagttaaaagcttggcagataataacaacaacaaccgtaatcatgataatatgtactgagtacttactctattcagtccttactctaagcacctgagagacgttaactcttctaatcctcatgacatctctgtgaggttggtactattatcatcccattttatagaggaggagctggagaaatagtgaggtcacgaggtaagtgacagagctgagttatcccaggcagtcctctaaaccacactgcctccataaaggagattcaggagcatacaacatcaataaacagaaccatgttaatacaagagtgttttttatccacagaaataatgatgcctggcatgtttatagaactatgcaatttataaaaaggattcatgcattcatcatcccaactgattctcttaaagtagtctggatgtatatattttatccatactgcacaggttctttcattcattcaattcaaatatgtattgagcacttcaattcaactagctttggagagagagcagtaatcaaaaagtatctcacccttgccttcatagagcttactgtagcagacaggacattctttaataaataatcacatgagtatgcaattacaaatggtactaagaactatgaatgaaaagtactgggaatgctgagagcatataatagggaatgacctagtcacacactctcagactcactgatagaactatcctggaaggtaagatgttcctgagaaagctcatttgagctgaagtctaaggacaattgagaattaatttaaatgcaacagtatcaataaaagcttcctaccatcctatttaaaattgcaagcattttgcatactccttacccatttatgtttttctgtatcaattatcatcttctaatgtactatataatctacttatttattatgtttatttatggtctgattccccctcaattagaatgtagatgctatgagaatttttaaatcagttgcattcactcaagtgttctgcatatacagcccctcggtaatacttgttgaatgaatgaatgaatgaatgaatgaatgaacaaagaaaccagtagaaggtgtttgggggtgtaggggctagcagtcagatgggatttctcagtagacaggtgccttttttaaatgtcctgaggcagaagagcacataaagctcttaaaagaactcaagaggcccggtacagtggctcatgcctataatcccagcattttgggaggccaaggcgggtggattgcttgagcccaggagttcaagaccagcctggccaacatgttgaaaccctgtctctactaaaaatacaaaaattagctgggcatgatggcatgcacctgtggtcccagctacttgggaagctgaggcaggagaatcacttgaacccgggaggcagaggttgcagtgagccgagatcatgccactgcacccaacctggtgacagagtaagactctgtctcaaaaaatatatatacaaaaattagcctggcatagtggcacatgcccatggtcccaggtactcaggaggctgaagagggagaatcacttgagcctgggagatggaggttgcagtgagccaagattacaccactgcactccagactgggcaatagagcgagactttatctcaataaaataaaataatagaggaactcaagaagaccagtgtgtctggagtgtagagaacagaacaagtgggaaagtggcaggagatgagatggacaggaaagcttgggccctttgctgaagaaatggaaagtcagggtggacaatccaaaaaaaggaggcatgatttggactccaagttagatatagccaactctgtcatctctcacacttctccaagaggtgtgcattctccataacagggaaatatagaatactccaattggagaaatatttaatacattttttaaagatggtcacttaacatgcttgaggcagaagagcctgatgggtatggttgatttatgagtatctggatattgatgcagggggtgtcaaagtgcattaattttgtagagtttcctaattctagtttgttaaaacataatatttaaaaagtggtatcctagatcatttactgtctcagctagggataattgatattgtggcagatagccagcattgttggcagaaagagaatcttacaggaggccagcaacatcagacattccaggacccactgatagatttctacctgccagccccaaagcatctttgtcctcttacaggaaagagcaaagtgttccttagccaggcgggtggatggtgctctcctttatgtccctgcttgaggctcaggagagagaggtttgtgtcttttaattaaaacagatctttgtcaaactagtgttttgactcaaagcttatttaatagactcccagactatgcctaacatgtggtaagagtcatgaaaccgtgtggcacggtattacagaaggtgctttgggcttgcttctgtcaaacaaattaaatgcctgcacttcatacactttacaaggccaaattaaacactcatcaaagaggagatgccttttaatgtgcagtgcctgcagcctccttgacactagctagcttgctccacaaatcccaggctgtctcggctaaatacaggacaatggcattttctctcctgagctgtcgtttccaagatttaggtcttccctacaaggatacttctttttccagcaattctgaaattctagttagcacctagaagatgttagctacccttttgttcttcttcttcttcttctccttctccttcttcctcacggagtcttgctctgtcacccagactgcagtgcagtggcacaatctcacttcactgcaacctctgcctcccagattcaagcgattctcatgcctctgcctcccaagtagctgggattataggcaccttccaccacgccaggctaatttttttgtatttttagtaaaaaccgggttttaccatgttggccagtctggtctcgaactcctgacctcaggcaatctgcccacctcagcctcccaaagtgctgggattacaggtgtgagccaccgcacctggccaaggtagttcattcttgcaaataaacattgttgaaagtgtcagttatccatctttcctagaaagtattaatatttcatagtaaattaaatgagaccagcatgccagaagcccttcccagactgttcacaaattgaggctgtgataattaaaatgtgattccattttctgacatggacactgctactaattctttggtttctataaactagaactagctagcacaccatttaaattaaaatctagactaaaccttacataagcatgccaggttgtgcttttgccagtcatgtattgacctgggaaatgctttgataaagtactaccttgctctaagttatttctttgtattccagctttctattcattctggaattttacattccaaaggctaaaagagaccttgaaaaatcatctagacaaggaattctcaaatataagtcagctaaacaaatgcattagaatgacctgaagcacttactaaaaatacacgtttccagacttcacctcagacctactgaaacagaagctctggttgtggaatgtagggaccacattaggaataagtttctcagccagtgcaatggctcatgcctgtaatcccaacacttcaggaggccgaggcgggaggatcacttgaggccaaggagttcgagaccaacctggccaacaaggctaaaccccgtctctactaaaaatacaaaaattagctgggtgtggtgtcacacacctgtaatcccagctactcaggaggctgaggcatgagaatcatttaaacccgggaggcagaggttgcagtgagccaagatagtgccactgaactccagcctgggcaaaggagcaagactcgatcttggaaaaaaaaaagttcctcaagagagtttagatccttcctcaccatgtttgagaaccagtcctaatctccgtcttacccccagtcaaagataatatataagcccacttggctgatgagcccttacatagagatacaataaacagtcctccatttttttttttgaaatggagtcttgctgtcttgcccaggctggagtgcaatggtgggatgttagctcactgcaagccctgccacccaggttcaagagattctcctgcctcagcctcctgagttgctgggattacaggagtgtgccaacatgcctgctaatttttgtatttttaatagagacggggtttcaccatcaaactcctggcctcgtgatctacccgcctcagcttcccaaagtgctgggattacaggcatgagccaccacaccgggccctcccttttaaattactatttaggaatagagaaaggcctcaagctgcttgcattaatttcacatcttcattctattatctgggttaggtagggcattgtgtttcaagaaagagtaattcaacctttaagtcagtacccaaagggttcaaatccagtagtgggctatagtgtctggagattcccagtgagataagaatcatcgccaagcatgtgacgcatccactcggagcaggactccagcaggtagcttctctaacaggaaacaagtcccagacaatgaggcgagcaggccaaccaaagttgggtgagagatggagtgcaactcaagcaattataataatggctagcttttatataaggcttactatgtgccaagcactgttctaagcacttccatgtattaaataatttaatcccgaagtggaccttttacatagccactattatgaacccctttcacaaatgaggaaaccaaagaagcacagaaggattaagtaacttgcccaaggtcacacagctagtaaggagctgagctgggattcagcctccagcagggtggctctagaatacacatctttaatcattaagccatattgcttctccagcaggctgatgattagtatagtgttgtgctcaacaggggaagtgaagcacaatagaaaagaccatcagaagccttaatatatgcacaaggccggtcattaaaagaaaattgcatcttggtgaacaccagaacacttcaagcacaatgaatcccacaccttataacagcaaggccaattctagaccaacctcaaccacaggatggagtaggggatgctcctgctgtccctgctctagcagggatgatggggtcaggaaaggatggggttggacattgtcttctcagcttaggctgccacaacaaaataccatagactgggggacttaaaaaaacagaaacgtaggctgggtgcagtggctcacacctgtaatcccagcaactcaggaggctgaggcaggagaatcactggaacctgggaggtggaggttgcagtgagccaagatcgcaccattgcactccagcctgggcgacagagtgagactccatctcaaaaaaaaaaaaaaaataggaatgtatcttctgacagttctggaggctggaagtctgagatcagggtgctagtgtggttaggttctggtaaggtctctctttctggcttgcagacggccttcttcttgctatgtcttcacatggttttcctttggcatatgcacatggggagatagcaatatctctcactcttcctcttcttataaggccaccgatcctctcaaagtagggcctcatctcaccttaatcatctcctaaaagccctatctccaaatacagcaacattgtaggtcagggattccatatacaaatttgaaaggggaagcatttcattccagagcaggaatttagctataatgagcatccaataatctaaaaaatgtaaactcatagaagcagaagaatgatggttaccaggggttttgcaggggttacgggggaaggaggagattgggaagatgttggtgaaaggatacaaaatttcagttagacaggaggaataggttcgagaaaacttgttctttgtgcatcctggtgactatagttaataaaagtgtattgtattcttgaaaagctctaagtagatgttaagtattctcaccacacacaatatattaaagtatgtgaggtaatgcatatgttaattaattagatttagtcatttcagagtgtatacatatttcaaaacagtatgctgtacaccatatgtatatacaagttttacttgtcaattttgaaagaaagaaaaaagagagaaagaaagaaagagaggaaagaaagaaagaaagaaagaaaaagaaaggaaggaaggagagagagaagaaagaaaaaaggaaggaaagaaagagagagaaagaaaaagaaagaaagaaagagaaagaaagaaaagaaagaaagaaagaaagaaagaaagaaagaaagaaagaaagaaagaaagaaagaaagaaagaaagaggaaatctgtatgatgtgcaggttgcatttgactaagctcctgggggaacaacctcaccgtcctctgcttagggtcaatgaggctgcatcaggcttcctctctctctttctggaaacatgtttgatgggggaagaagaaaatggcttgtgatacagtaccaaaggagcaggctggggatacctgagagcagcattctagaactcagatgtgtccaggggtctggcaggtaacaaaagcctgaagccgacctagtatggtgagattggagtgggcaagtctcatcttcagaggcagctccccggcagctccagcccactgtctccaagaggaatgcagggtcagtgaagacatccttttgttttgttttgttttttttctttgagactgtgtctcgctctgtcactcaggctgcactgcagtggcacgatctgggctcagggcagcctcaacctcccgggctcaagcaattctcctgcttcagtgccccaagtagctgggactacaggcacaccccaccaggcctggcttgtttttttgaatttcagtggccaggactgaatggtgcaccagaacgcccaaccaattttttactttttgttgagatggggtccctctatgttccccaggctggcctcaaactcctgagttcaagcaatcctcccaccttagcctcccaaagtgtgagccacagtgcccagcctttattttctgaaaagcaaaaattccggagttttatgtaaaatctcccccatcttccaatgtcttcctttaaaagatacgtggcctaagaagaatctcattctttataagcctcagtttcctcaccagtaaaatgaagattatagatatatgaatctcataggattttttagagtatcaaataaaatagggtatataaaaatgctttgtaggccaggtacagtggctcatgcctataatcccaacactgggagactgaggcgggtggatcacttgaggccaggagtttgagaccagcttggccagcattttgaaacccccatctctactaaaaatagaaaaaattagccaggcgtggtggcacgtgcctataatcccagctactcgggaggctgaggcacaagaattgcttgaacctgggaggcagaggttgcagtaagccaagatcgtgccactgcactcaagcctgggcaacagagcaagactcttgtctcaaaaaaaaaaaatgctttgtaaactatgaagtgctatatactgtgaacagagacacccatgaaaagcaagttctctccagtggtagtatgatatatttaataacgaggcgtcacacccctgtagagtctgcacaagagccagagggaccttttaaaaatataaatcagattttaccctctctggcttaaaactctccaaccaattcccatctaaaaataaaatcagatgtttctctggcttccaaagctgtgcatgatctgggaactgttaacctgtctgacctgatgctgcactctgccttcatgtagcacactccagccacaatgcccttgtttctgctccttacctacaacaggctcattctcctcttagggccttggcactagacaactggttagctggaaccctgaccttctgcatggtggtttcattcttatcattcagctctcaggttaacatcaccatctgagagatgctccagtccagaaaagccactggtcactctcagcaatagcaccctgtttatttcttgacaagcctgtctcactgatatgtttttcaatttttattggtttgcttatttcaaaaatgtatcctcccactagttataagcttcaagaaaaagagacttatttaatcttatttaccactgtatctgccagcctctgaaaccaagactgctacatgggaggaattagtaaatattcattgaaagaataaccttaaaattgatattatagtagaaagtttagcagagaagtagaaaagtattggactggaaccagtgcagtttcctgggctctgctccaggttcaatgaatctgaatctctagaaatatggcacaggtatctggattggcccaggtatcagatgggtgattctgatgtaagtgacttcagaacacactttcaaaaaacaacaggctgggtgtggtggctcacacctgtaatcccaacactgggaggcagagactggcagattgctttaggccaggagttcaagaccagcctgggcaacatggcgagatcctgtgtctacaaaaaagacaaaaattagctggacatgctggtgcgggcctgtggtcccagctacttgggaggctgaggtgggagaatcacttgaacctgggaggcagaagttgcagtgagccgagatcatgccaatgcactccagcctgggtgacagagtaagacctcgtctcaaaaaccaaaaatcaaaacaaacaaacaaacaaaaaacccactggatttagaagccaaagactgatttgcacattctgtttatttcacagggttttcatggggacttaagataatggctgataaatttctttgcgtatgcccagccttacataaatacaaagccaaagagctatttttccatagcctgtcaggggcctgcaatatgtgcattcaggggagagaaactttctgtgctctgaggcagctccgttcactatggaggccttcctttcacggaggcgagcaaatccgctccctcttccacatgacatgtcttcaaggattgaagacaaccagactggctgcctttagcatttctggctctttagccattcttaagccatggtaacctggatatatttcagtttgttcagccagttttagagtatagatttttataatttaataaaacattccattatggtctgtttaacatagttaccatggtatcattacatggtaactatgtataatgaatattataaaaaataactatgactgtagtctcagggtcaaacattcaggaatttgagttttttctcagctcaataaaaatgaagcatactcttgaggaaagaaccatttgtagaatttcacaaaagactggtgtagaaactaaaaagtccagtgtatcaatctacagtgaagaaaaccataataataactaacatgtatttaaaccctgactaatggccaagcaccatcacacatcatcttatttaatactcactactccataagtagggatcatgattctccccatagtataggtgagaactgtcgaagcattggtaacttcctcaaaaatcacataattagtattttgcaaacttcgttttaaagcgtgaccccaaggccatgtacctacccatcgactgtgtacttacctactggccatgtacttatcctctgacaccataccaattggtccactttggctcctcactttctgttttttattttttattttatttatttatttatttatttatttatttatttatttattttgagacggagtctcgctctgtcacccaagctggagtgcagtggcgcgatctcggctcactggaagctccccctcccgggttcacgccattctcctgcctcagcctcccaagtagctgggactacaggcgcccgccttcacgcccagctaatttttttttttttaagtagagacggggtttcactgtgttagccaagatggtctcgatctcctgacctcgtgacccacccgcctcggccgcctaaagctctgggattacaggtgtgagccaccgcgtccagcctggctcctcattttctatgtttcttgctaaccatccatttacctttggactgacaccttctatttttagacataatatcactgattattccacaatcaaattccatttgcatttccagtttcacccttgaagttacttttgtatagacctaatcccatccattatgtatgttgattttgtaattttagtcttggagttttttggggagggttccttgctgatgtctgtaacttccttcaatgatcaattaaaacacttaaatatttttccagcttacttacataaagctaggcttctataattgtgccattgattttttttttcaatctaaacacaaaactttgcatatatccctgtgggatactatcttgtgatttttggacaaatattctagctcgtcaagattattttaaatcttgattctatcatctgcggtattagctattccttccggctctctgtcatctgtaggttttgttaaatgaaacatctattcctcatgcaaataattgatagaaatattgaactgcacaaagccaagtatagagaaactcacaggaggaattaaaaaaaaaagaagaagaagaagtatgggccaggcgcaatagctcatgcctgtaatcccagcactttgggaggccgaggtgggtcgatcacctgagatcaggagttcaagaccaacctgaccaatatggtgaaaccctgtctctactaagaatacaaaaattagccgggcgtggtggcaggtgcctgtagtcccagctacttaggaggctaaggcgggagaatcacttgaacccaggaggcggaggctgcagtgagctgagatcgcaccactgcactccagcctgggcaacagaggggagactccatctcaaaacactccagcctgggcaacagagcaagactccatctcaaaacactccagcctgggcaacagagtgagactccatctcaaaaaaaaaaaaaaaaagtatggtactgaactaagcatgagaatgtgaatctagtcactagaagtgatcccagatgcactatggaaaagagtgatttcctacccttctcagatactcttcgtgatgctacatgcagacaaatgcaccagtgtcattatcaaccctttaatgtacttccttatctcctataatacattacctcaatagtcaacaaatattgattacttaccatgtaaaaatcattgtgcatatgtgctggggttacagaattgaggaaaaaaattaaactaatcaccatagtgtgataaatgctatttgaaaataagtgatatgggagaccatgagggagacacataaatatgcttgacaagagatcaagaaagccttcttaaaggaggtggtgcatgggttaaatttgaacatgaagtgtagactgaccaaacaaggagttggaagtggaaaggttgtcaggcaccaaggtcataatgggcccctaagccatgttaaaagactggggtttacatttaaaagagtaaaagctttgggcctggcaagatggctcatgtctgtaatcccagaactttgggaggctgtggcgggaggatcgcttgagtccaggagtttcagaccagcctgggaagcatggtaaaaccccgtctctacaaaacatagaaaaattagccgggtgtggtggcgcatgccagtggggttccagctactcaggaggctgaagcaagaggatcacctgagcccagagttcaaggctgcagtgagctgtgatcataccactgcactgcagcctgggtgacggactgagaccttgtctaaaaaaaagaaaaaatttaattaaagttttaattaaggactctgtccatgaagtgttctctatctacttacacttttgtcaattcctcctgccttgaaaatcctacagtagtttttttccatcccactcaggtcctgtatttttacctcattaatgtgaatatggatcttacatccctgaatttcatggaatggcatccagactgggaatatgtctcatattctcactatatccatttgtatcatcttgcacagttccaggcaccaggacagtgaacaaattcttgatgaattgaatagcagcaatggcaatgaatggcaaacagtagtagtaggggatcagacaggagggtgacagccaggaaaaatggcacacatgcctgagggagcctgagactgacaggtaaactctgtaagggcagggatcatatttgtgctgttccttctttgttccaagtgaccagaagagttgtatcattttttatgttcagtcttactttccaaggacagattatccctcaggagttctttgtttaggttcctgcatctagggctgatgttgattttatgcacaatttctttatccatgtcaatgtcaagatatagtgagttttggagagtatgcagcgctgggttcaaaaactagtctgactccatgccttcttctgtttttgagacagggtctcactctttcacccaggctggagagcagtggcgcgatcacggctcactgcagcctcaatctcccgaggctcaagggatcctcccacctcagcctcctaagtagctgggaccacaggcgtgcaccaccacacctggctaatttttgaatttttagtagagacagggttttaccatgttgcccaggctggtctcaaacccctgagctcaagtgatccatccgcctcggcctcccaaagtgttgggattacaggcgtgagccaccgcaccttcccctgaccctttaactttatttaaccagtcagaatatgtagaaaagggacggagaatagattgcaacttccatgatgagtcagtcagattgattgagaatggcgtactgggcctttggaaagcatgtcacaatgtaattggtgatgtctgttggccataaaagaagtgttgagtggaactcacaagggccgtgcatatgttgcctcttataactattgccattaatgtgggcaaaaatgtttttctgaaagttggcacaatctaaatgtgccaccttataaactgtacgcaggtggctccagcctttaacctttgtattatgaaataaaatatgtatacctaaaacatattactaaacaaaaatatataaggtatgcaaacaaaaatatgcagctcaacaatttgttcaaagtgaacgtgtgtgataccaccacccaggtcaagaaacagaacatgatcagcatcttagaaactcctccctttagttccctccaaacattacctaccatgattttgactttcatgaatactatgttcttgctttcctttataattttatcacctacagacgtacccataagcagcacagtttggttttgcattggttttttctttcttttttttttctttttttttttttggtactttatatgaattgaatcacatactacacattcttctgtattgggcttcttttaatcaatattatgtttgtgagactgatccattctgctgcaagtagttatagctatagctttagcttattctttttttttttttcttttcttttcttttctttagagacagagtcttgctgtgtcacacacaggctgaagtgcagtagcactatcatagcacattgcagccttgaattcctgggctcaaacgatcttcctgtctcagcctctcaagtagctgggactacaggcatgtgtcaccatgcccagttcattatttaaaattttttgcagagacagcatcttaatatgttgaccaggtctgaactcagcctcaaacaatcctcctgcctaggcctcccaaagcatagaggcatgagccacagcgcccagcccttattcatttttcactgttgtgaattattacaaagtgggaacatatgaccacttaatttatctagtccacagatgatggacacttggatggttcccaatctctaactagtttgaataatgttgctatgaactttcgcatttttggagcacatatttctgttggatctatacctagagactaatttccaggtcacaaggtattcttatgttcaacattagcagatagggccaaactgttttccaaagtagttgcatcaatttcacatctaccagcaatgtacgagaatgtcaattactccacatgcacaccaacggttggtgtttctcagtctattgattttaacccttctggcatgtgtgcgatattttatgtagtttttaatttattattccctgatggctaatgggcatcttttatttattttaccatttgcatatatatatatatatgtatgcatatatgtatatatatatatatattttttttgagacagggtctcactctgtcacccagcctggagtgcaatggcatgatctcggctcattgcaacctccacatcccagattcaagcgattatcctgcctccacctcccgagtagctgggattacaggggcctgccactgcgcctggttaatttttgtatttttagtaaagaaggggtttcatcatgttggccaagctggtctcgaactcctgacctcaggtgatgcgcccaccttcgcctcccaaagttctgggattacaggtgtgagccaccgtgcctggccttgaatatcttcttttgcgaagtccctgttcaagtctcttgcctgtctaccagatttgtcattttgtattttttttaatgataagagttatttttatctattctggacataggctttatcagttaagtattttacaaataccttctcctgtttgatggcttcctttacactctccgaatggtgtcttcagaggaaaagaagctcttaattttatgtaatccactgcatcaatatttctcttgagattttgtgcttcatttcattcactttaagaaaaatttccctatcccaaggttgtgaatatattatgctatactatcttctagaagcttcattgttttatccttcacttttaggtctacagtgacctggaatgagtgaatgaatttgtttatgtttagtctggtgtgaggcagtaagtcatttaatttttttaatcaggatagccaactgacccagttttggaaaagtctctttagaaacaacatctcgctttgaatcaagtgctatatgtgcatgggtctcttactggaattcctattttaactttgtattcaggtggcaatactacactgatttctgcagtcttcatatgcaatggagcaaaccctcccagtattcttcatcaagtaccttgtctattcttggccatttgcactaacatgtacatttagaataatctttccaagttccattttaaaattccagttggggttttcattgggaatacattaaacttatagatcattttggagagaaagaacatatttataatattgtattgtccaactttaacacggtatatgcctttttaatttaggtattttaacataatattgttatgttcttgcacatgttttctgaggtttattactgggtatttcaaaattttgatgttattttaaaagattacttttatttatttatttatttatttatttttgtttgtttgtttttgttttttgagacagagtctcactctgtaacccaggctggagtgcagtggcacaatctcagctcactgcaacctctgcctcctggactcaaggggttctcctgcctcagccccctgagtagctaggattacaggtgtgcgtcaccatctacggctaatttttgtatttttagtagagacagtgtttcgccatgttggccaggctggtctcgaactcctggcctcaagtgatccgcccaccttggcctcccaaagtgctgggattacaggtgtgagccactgcactcagccgaaagattacttttaaatttctattttattactgttcaaggctggaatatagaaatacaatgttttcacatattgctcttgtatccagtgatctgctaaactcaattaagaattctaataattaataggtattctggattttctatattccccatcatatcatatataaataatgagagttcattttttcctttccaatctttatgcagtaatgtaccgcataacaatattttggtcaataacagactgcatatacaacagtggtccaataagattataaggaaagcagggcctaatggcacacacctgtagttctggctactctggagcagatgctgaaagattgcttgagcccaagagttcaaggctgcagcgagctatgattgcaccactgcactccaacctaggcaacagagtgagaccccatctctaaaaaaaaattttaattttaattttaaaagattataatgaggccgggcacggtggctcatgcctgtaaatccagcacgttgggaggccaaggcaggcggatcatgaggtcaggagttcaagaccagcctggccaacatggtgaaaccccatctctactaaaaatacaaaaattaactgggcatagtggcgcgtgcctgtaattccagctacttgggaggttgaggcaggaaaatcgcttgaacccaggaggcggaggttgcagtgagccaagactgcgccactgcactccagcctggtgacaaagcgagactccatctcaaaaaaaaaaaaaaattataatggagctgaaaaattcttatcacctaatgacttcatagtcatctcaaagtcatggcccaatgcattaccttctctatatttagtacacaaaaaatatgtaccattatgttacaattgcctacagtattcagtacagtaacatgctgtacaggtttcagcaagaacaatgggctataccatatagcataggtgtgaagcaggctataccatctacatttgtgtaagtacactttatgatgttcacacaatgacacaatcatctaatgctgtgtttctcagaatgcattcccatcattaagtgacacatgacagtacatttatttctcttgttgccttgctgcaatcactaactaggatcagtacaatattgagtagaaatgttgataatagacatccttatgatgttcccacttctaaagcttttaacattttaccaccaagtgtgatgtttgctgttggatttttgtagctacttttttcagaataagtaaattcctttgtattgcaagtttgctaagatgtttttaatcaaaaataggtgttgaatctcattagatgctttttctgcatatatttaggtgatcatataatttgtctcttttatttaatttatgcagtatgttggttgagttttgaatgtccaaccaaccttgaattcctggattaaacccaaattggtcatgatttattatcctttttcatatattgctaaattttttgctaatttcttaaagtttttatgtctatcttcataagagagattggtttatgattttcttaaactgtacttatgaagttttggtattaaggttattctggcttcatagggtattactgtccctttttctactctgaaaaaaattttcagaagattggcattatctcatctttaaatgatagaatttgctggaaaagccatttagttccagattttcttcattaaaaggttttaaatcatgggctggtagtggtgactcacacctgtaatcccagcactttaggaggccaaggcagacagatagtttgagcccaggagttcaagatcagcttgggcaacatggcgaaactatctctacaaaaaaatacaaatattagctgggcatggtggcatgtacctggagtcccagctacttgggagactgaggtgggaggatcacctgagcccaagaggtcaaggctgtagtgagacatggtcgcaacacttcactccagccagggcaacagagtgacactctgcctcagaaaaactaagtaaataaataaaagtttttaaattatagattcaatttatctaataattatcaaatcatttatattttttctttctactatatccattttggaaagcttcatttttcagcaaatttgtctattttatgtaaattttcaaatatatttgcttagttatttatactatcctttcattaaattttttaatgtgtgtaatatttgtaatcatgaccattttttgtgacattagatgtgttttctgttttctttgctttccctttttcatgttttttccatgagagatttatcaattctattagccttttcaaataaacttttggatttattgatcctctctattctgttttctatttcatttgtttctgcttttatctttattatttcctatcttctattttatttgtttaatttgcagctctgtctctaaatgttcgaaatggatggttaacacattgattgacagcctttctctttttctaatatacatctttgaagctatagatctttctctaagaatgactttagctgtattacactagttttgatacatattttcaattttttagtttaaattattttttaattctcattgtcatttcttctttgaactatgggactatagaacaatatttattaattttcagatagttgaggatttcccattctgtttttgctactgatttttagcttaattgcttgaaataaaaatttttgaaaagttttagaaactttctttatggtctattaagttttccatgtgcttggaaaaaaatgtgtattttgggatttttgtgtgctttattttacacatgtccattaatttaaatgtgattataatgcattttaatctgctatattcttactaatttttggtctgtggattctcttaggtactgtaagtgattattaaaatttcccattatactatttattagtctatctcacctttcagttttgtcaattcttgccttatatatttttgtactgttattaggtacattacaatttcctatgaattaaatcttttttcagtgcaaagtctctcttcatctctagtaatgctttacaatatgtataactatagcagttgtgttttggctactattatgtattttttttttatttttcttcaacttttctgtatttttatgccttaggtttgtctcttgtaaacatggtagatatggtaattttaaagtttgtgtctcataactcctatatctggagtcccaatagatctttttccattccctgttgattttgccagttctcgttcctatcgtcttatgtccttatatgcctagttgttttcttattatgcaatagtttttgtatttcagaatttgttcatagaattaatttgaggtctaggatgatgttatcttccccagagaggattcccatttgtctctgccctcaagccataatcacttcaatccaatttaaaggtgattcaagactgatcttagttcctgtggggcctctctatttctggttcacccacactcccagggttcagaccttcccagcgttgtaactcaggcctcccaacctgagcaggcactgatgtttaatttctgttccccaaccttaatccttagccactctctctagaatgggcaaataaccctagtggaaattaggcccaaatgctctagatactggccacataattcttccctaccttgctagttctccaatgccttaaggcggatgtttttatattcttatcagcttttctcattgtcctcagggggatgatcagtccaaattaccttgtcaccattactagatagatgtacactctgctctgttgattttgtttttaatatacagtcatgcattgcttaacaatggggatacaatctgagaaatgcatcactaggcaattttgtcattgtgtgaacatcatagagtgtacttgcacaaacatagatggtagagcctaccacacacctaggctatatggtatagcctattgctcctaggttataaacctggacagcatgttactgtactgaatagaaaattgtaacacagtggtaattatttgtgtttccaaacatagaaaaggtaatgcattgtgcgaggatgttaggacagctatggcatcactaggcaataggaatttttcagctctgttatcatcttatgggaccactatcatatatgcagtcattaggcaatgcatgactgtaaataattttacactatgttcttattatgttttcttattatgattgcttccttattatgaaagttagacattcccacttttagaaatttagcaaatacatggccgggcatggtggctaacatctgtaatcccagcactttgggaggccaaggcaggcagatcacttgagctcaggagttcgagaccagcctggacaacatgatgaaaccccatctctactaaaaatacaaaaatgagccaggtgtggtggcatgcgcctatagtcccagctacttgggaggctgagacagaagaattgcttgaaccagggaggcagaggttgtagtgagctgagattgtgccactgtactccagcctgggcaacagagcaagacttcgtctcaaaaataaaataaaataaaataaaataaaaatttagaaaatataaacatggaaaggaagaaaatagaaatcacttataattccacttttctaaaatatatttcctactggtctattttgtatgtatatatacaaacatttttaacaaaaatgagatcatgcggtacttactactttataatgtaatttattcatttaatatatcagagtatcttgatggttgcatggttttccaaggtatgtatataccacaattcacttaaacaattattgaatatcagaatttttccaatattcaacattataaaaccattgtcacaaacattattttgctaaatatttgaacagttcatgattatttccttaggattaactcctaaaagtagaacagataatcagaagatataaggcattatatatactgacaagttaccctccagaagaggattaccaatgtacatttctactagcagtgttagagagtgatattgttcccttccgacaaccagattggagctactaagcaattagtcgcataccaacataaatgagatttaccatcttaaaacaattttaaaaggatttttaaagttttctgtcctggattttgccatgattgtaactgatttctcccttaataaggaaaataagccatcagctcagagaccagagggatttaggagcttagcaataaaccatcaaccatttcctctactgggagtctgtataaaagttggtttattgtcatggaatatgatgcagccataaaaacaaatgagatggcactcaactcacagaaagtaatctctaatgatgggctttccaacgctatatggcccctatactaaggaagtagctggcatctctcattttatgcccccatacatctacccaaactgaggaaagagaaattctacaatatcaatatggagaaggaaggctatggttctctgtgtactttataaagagtattttgttctatgctcattattgtatatcctgggaagcctaattttagttttatttgaagatgaagaaagagaaacattaagccacacatgcttttcattttttgtacaaatttatggtgtatgtgtgcaatttttttgtttttctgttggttttgttttgctttgttttgttttttttgagatggagtctcactctgttgcccaggctgtagtgcagtgacacgatattgactcactgcaacttctgtctgctgggttcaagcgattctcctgcctcaacctccagagtatctgagattacaggtgcctgccaccacgtctggctaattcttgtatttttagtagagatggggtttcaccatgatggccaggctggtctaaaactcttggcctcagtgatctgttagtcttggcctcccaaagtgctgggattatcggtgtgagccatggtgcccagctgcaactttgttacatgcatagattgcaatgtggtcaagtcagggcatttaggctatcaatcacccgaataatgtatattgtatgcattaactaatttcttatcaccccccccccttattctctcacctgtctgagtatccactgtccatcattccactctgtatgtctatgtgtacacatttttaacactcacttatgaatgagaacatacaatatttgacacacatgccttctaaactaggtattgatgaaataaaaacttagtttcaaaggcttatttttcttggtgtattcactgttgtggaattaccctgtggaaatagcagatagctgcttctggaatgtatcgtgacataaaccgataaattcagcaaagacatctacctgtcaactgacttttatactccaattatgttattttagttttatttctaaatattattagacaataattagaaatattaaattattggccgggcgcggtggctcacacctgtaatcccagcactttgggaggagggcggatcacaaggtcaggagatcgagaccatcctggctaacacagtgaaaccccgtctctactaaaaatagaaaaaattagccgcgggtgctggtgggcgcctgtagtcccagctacacaggaggctgaggcaggagaatggcgtgagcccgagagtcggagcttgcagtgagccgagatcacactactgcactccagcctgggcgacagagcgagactccttctcaaaaaaaaaaaaaaaaaaagaaaagaaaagaaatattaaattattaaggccctggtttaatccatgagacagtagattacagcggtaaatagcatgagctctggggtcagaccgtaggagtttgggaaagtgacttctagacaactttgagcaaattacttagcatctctatgtctgggcttcctaatctggagaatgaggatgacagtggtacacatttcagatggttgctttgaggattaaatgagataatacctgtaaagtttagaacaatgccaggcacatggtaaggcttggagttagttattgtagaaggggctctataaataaatgtttaattgaaaaaaatcaacagtccaactgggggtggcagttaaccactcttaccccaaaatggaaacctcttgctattggaataactttccagaataaaatatatgaaagaaaacttgatgaaatacaggcattaaatgttatcacataaccatccgtaaattctgggtttccacaaagcagttcttccgaatcataattaagggtttgaaagtcaaatgatttaactgctagttttaattacctcttggtgaactttagtgtgttagaattgtcacaactttccttgaggattactctgaagtcaagcaatacagtgggaaattattaactcctactttggtacagcaattatctgcattacaaggtttatgcaattagctgtttaagatgtcattatattttgccatctggtacacaggagtttatgcatatgaacaggcacgtgttgaagtgattttcactatatgacttgttctcaacccaagtcatcgctctaatgaggggaagttgccgtgcaccgtacattagtggcaggtgcacactatcaagcttcattttcatcgaagaccttcatttttccattttaaagtattctgcacaagtgctggaaaattaattagtcgttctcaattgaacaacgcctgcagacgtgttctttagcagttaggcgggggcacggcttcaggtaggggccactcctcctcctcacccggacggctgcaaggaaccctcattctgtgcaaagccagggcgcaatcctgtgcagtaaacctcccctcgcgaagagggaagcggggttcgctgttgcaccccaggccgagcgccctaggggagagggcgccgcagcgagtcccgagatccgagcccggcctcgacgccggagcgctcccggagctggtccttgcccgaagcgcattaaaacggcgccctctggtgtcagctcgcggcggccgggtaaaagcagtggcgctgggggtagagttctactcgccaccctgttcgcaaactgaaagatccccgagtttagaaagtgtcttgccgctctgcggacgctgtgtccgcggccccgctgtcgcgcagagctgggctgcgatcagaaagtccggctcccctggccccagacagtggctcccgggggaaccagcgtggagggtgaggagggacctggccttcgaaggcaggaaggacagaacccccaagccacgacggcagcggggcgcggggacggccgggctccagccacagaggcccgaactcggcccgcactgcccggcggcaggccgcgaaggagccccgggtagtgggggcggcaggaaggagaggcgcgcagggccttcggggcctccccaagccccgggctcccgtctgggctttgtgggttggcggtgtctgaatcgccgacgggccgagccgtgccgggaaggcgcgcggccccgcgcgggcacctggccgaggccgccccgcgctgccattgaaatgtgacactgatgaacgagctaggcccgcggctttctttgggagagttggaagtcgccagccgcgagatctggggctctcaggttccctgggaaacgttctccccgcaccccactgcctccaccttcggcactattgctatcctctcccatttccccccaacacacacacacacacacacacacacacacacacacacacacccctcacgcgttttcgagtgccagaccaagagtcttaagttcagctccaggaagacagggtagtggcgggaaagaacattctgacgacggggaagtttgagttggttggggctgagtcaataaagtcgccccttgagccttttgttttgaggctttgattgcaacggcgcctttcgccttttatatttggggcctggtgggtgacagtgaggggacagaggaaggggacgaagcacgtggaacctggccccttttgggatgtttctgcaccagcttttgttgggggagaggatgggaagggaaggagggagagtgggtgccttacaggcaaccagcaaggatttcttgagagacaacaacgtgcggagcactgaatcaggcaccagcagcgcttattgagaatgagaataggatcttgcaagctgattagcgagagaaaaattcaaaaaagggacaaattggttagattaagtatccaaatagatgcagcaaagctgagtaaacaaatcaaggatgggtattggaattggctagtggagtctcagagcatctgtgtgtggacatctccgtgagtccattgcagttcagaggttgttctatgtaggctcagcctagaaaacagatacttaataaagttcgagatgacgttgtcaaaaaaaaagagccaatcattccggttggaagataaagttggacaagtaaatcaagcccagactgagaaggctgaggggcccagaatctaacggataatctactggctttggggccagactagcacagaagcagccctatccaagcctcttaggaattgtaactatgagtctctgtttccctccgtgaaatggggataattatgccttggtattgtgaggattacacagggttaaatgagacaatgtccttgggcctaaatacttttggtattgatataacccctccttctctttcaaccatttcagaatcgttcccatgatccctaggctctgggcatcttcaggagttcttcaaataaatatgtgactatgcccatcttgtttatgttcagtcagctctgttgcctcagacactcagcagtccatgttttactgataccttttggagcctctaaattatttgaaaacactgagtttttactacaggcttcggtaattgactttcggagtaaccggcccatgagactggtccatttaatgtcaataataagtaatatcagtttattagactctcaccagtggcccttactgaacattccatcctccatgatcaagagcagcagttcagcttcttaagcaaatcttattcctgtctgttgtaaaaagtcatttcactgtaataagtatctgctttcccaaagctgaaactacacagaacagcctgtgccctgcaattgactcagggagatacccacattctgaagtactgagactgggacttgggaaggtcaatgctctgattcaacacaggtgatatgaagaacagtaatgagtttcaaagtggcctataggcctggtgcggtggctgacacctgtaatcccagcacattgggaggccaaggcaggtgaatggtcataagttcgagactagcctggccaacatggtgaaatcctgtctctaccaaaaatacaaaaattagccgggcgtagtggtacatgcctataatcccagctactcgggaggctgagtgaggcaggagaattgcttgaacccagcaggcagaggttgcatcgagctgagatcacaccactgcactccagcctgggtgacagagcgagactctgtgtcaaaataaataaatgaccaaagtggcctatagactggatcacagctctgccctttatttaccaaaaaaaagccctggattgctcatttttgggaaatggtaccaaaaagaagtagctaaggtttccagaaatatacctatccaatccacactcttacaccaatcaatgtgtgtttccatgacatggaagtcctaaagtctgttctcaagtcaccctagctatgtgaagatgatgaaatgagaaacattaaaattctagaatgaagatagtaatttcaggaagaaaatttatcagcttaatgtttgagctagggtatatgttctttgaacattatcctcatgattttattataacgaaactaaggcatgaacttgaaaaatgggagaatgggagaaaattttaccctaaaactaataatgcaaatgttgggagaaatactcttgtatttctccatatttctgctagcacctagcacctagaacagtgtagaatatacaaaatacattccattaatatgtgttggtttcaactggtttttctttacaaagcccccttatctaattaccaactggtccccaaaagctaacaatctaaccacccaaccttacatttggtaactttatagtgttagttacacagtagggttttcctgctaacgaatcctctgtggcatctgtttcaaaatgaaaatctattatattattagaaacactctcagtgtaaagaaaccagagatgaattgccaaagtctgagctcacgatattgtgttggcaagcaaaagcatcatggctggacccagtgggagaaagaagatggaatgcacacctttacatccaatgcccaactcaaacccttctatcagtaactccacaccttttgatgagttcagttgttttgggggatggaaaggcgttttctggttaggaatgatgaacgggttggtttgctacttaggtaagtaagaagaaggggaactaatgagtaattgttgcacaatgacaaaacaacactcctgaaagaagcataatttgcttccctgaacaatccagtcctttcatcataaaatgttcctattacatggatacagaccagcaaaaacatttgctatacaaaaacacctattgtaaataatttccataaccagatcgacaaagctctatgactatagtttagatgccaggatttgacaatagctagattatactaaacttttcattgtaatgtatacactaaaatgacatttggtcagtttggtcataaaataaatataaattattgatatttataaaattacaaattcactcattcttggtttctcccaatgcacccctgctcccttcttccatcatcaatattttcctaggaaacattataatctacaattaactgaggctgaaaacaccatcttttaccacatctttagtgtagcaaaagtaccgagcaagccacccttctgcctgatctttcttgataacttttttaagtaccctagagccagttggtgcgttcttggctgtaatgcagccaagtggaatgcattacattccacttgtaatgcagtggaagacacctgggtgtgtgctgggagatctgggctctccataacctggctctgccacttctctatgagactttaagtgactcacttgatctccctgaacctctccttcctcttctgtgatgacagaagttagtcttccttcacaaaggtgttgtgagaattatacgacacttgatatttaaaattcctaatctagtaatctagcacacagtaggtaaacttaaaggtagattaatgttaaagttagattctgactggacatggtggcttgagtcttcagtaccagctactcaggagactgagggaggaggatcccttgagaccaggagtttaaggctacaagtatgctatcaccgtatcggtgaacagccactacactccagcctgggcaacatagcaggatcacaactctaaaagaaaaaaaaaaaggtagattctgaaatatagtgaaatacagatctagggctcctagagtaaaaaaaaaaaaatttttttttttttttgagacagaatctggctctgtcgccgaggctggagtgcagtgctgtaatgtcagctcactgcaacctccacctcctgggttcaagcaattctcctgcctcagcctcccaagtagctgagattacagtgcccaccaccacacccagctaattgctaattttcgtattttagtagagacagggtttcaccctgttttggccagacaggtctcgaactcctgacctcaggtgatccacctgccttggcctcccaaagtgctgggattacaggcgtgagccactgtgacctgccaaaaaatatttttaaaagcagaaaaaatacagcaactatggcttgcatccccatgtctttgtttcctcatctttaaaattgggataatgggccagacgcaatggctcatgctcataatcccagcactttgggaggccaaagcaggaggatcccttgagcccaggagtttgaggctgcagtgagctatgattgtgccactgcaccccagcctgggtgacagagagagaccctgtctttaaataaataaataaataaatagggataatgtataccatatgagattgtgaaaatgataattaaatcatttaatagaggcaaatgataataaaaatagtaaatagtaatagtaagtcatccacaaatataagatgttgtttggtttttttggttcgttttgttgttgtttctgagacagttctagcttgtcacccagaccggagtgcagtggtgccatttcagctcaatgcaacctcagcctcccaggctcaagccatccttccatcttggctgtcgaagtagttaggattacaggcatgggccaccacgcccagcttttttttttttttttttttttttttttttgtagaaatgggtttctctgtgttgctcaggctggtctccagcctctgggctcaagtgacccgcgcacctcccaaacactgggattacaggcttgagccaccacatagccattgtcttttttttttttttttttttctctgagacagagtctcactctgttgcccaggctggagcgcagtggtgtgatctcggctcactgcagcctccacctcccaggttcaagtgattctcctgcttgactactgagaagctgggattacagatgtaccaccacgcccaagtaatttttatatttttattagagatggggtttcgccatgttggccaggctggtctcgaactcctgacctcgggtgatccgcccacctcggcctcccaaagagctgggattacagatgtgagccacagcacccggcctacagccgttgtctatgaggagataagctagttatcaaaactccccataacccatcctgtttcctactcaaacactgaaacctcttagctctctcccacttcctctaaggccctaatcttcaaggaacagaaagaagctaaacagtcttacaagttagatttcttagaataaaagatgggttttcacattagaaataggtgaaagttggctgggtgcggtggctcaggcctgtaatcccagtaatccaagcactttgggaggtcgaggcgggcagatcacctgagatcaggagattgagaccagcctggccaacatggtgaaacgctgtctctactaaaaaatacaaaaaattagtcgggcatggtggcgcgtgtctgtagttccagctactcaggaggctgaggcaggagaattgtttgagccagggaggcagaggttgcagtgagccgtgaccgcgctattgcactccagcctgggaaacagagagagattccgactcaaaataaataaataaataattaaaaactatttttaaaaaagaaataggtgaaaattccttagaaggcacctacagcttcttacctacatcatctcattaaattctcacaatgactctatcagacaggtaccactattccctcttttgagggatgaggaaacagagactcagggagataaagtaacttgcccaaggttacacagctattctcaaggaaacgtagtgcatcccatgaaaatagcctggagtcgagatactggagtcaaagtgcagccaaaattgtcagggtgcaacctgcctgtccaatcagagctgctacttctttgatactggaatcccccaattcctgaaattaacacccagttctccactccccaaaagcacacgctgagtgccctcagggctcttgctgttgccaacggacctataactcggtacaggctcaggcagctgagaggaggctgtggacacaacaggccttgctaggcttgctgggacggggccacattactttgcaggcgcgtctttctcctgcctgctatctagagctcgcctgtaggtggcgccctgcttcgctcaggggaatttggagggcgaggacacgggtcaccagctgcctcccctgaaggccaatttaagttgtcccctggcttgaactgagcgcaggaacctcggtgatggggacatgcccccctccccgcgcgctcttcctctcccagcccccctgccctcccctctccaggggctggcgggcccgcgcttcctccgaggtcgggctacgcggcgcgatctccaagcgctggggccgagcttggcgctccggggcggcgcttcggtccccgaccctcgggccggcccgctggcccccactccgcttcctcccggcacccgcttcgccggcagctgtagcggaggtggagggatgggggactgtgacccccgtgagtgccggcggggcggggcagctttaaaaacttctgaaaggcctggttcaaagcctcaaaggatagaacttgggccggaaggcggtttccacggaggggcctaaaagggggctgggggtgcacctgcagggccaggagctgcggcttgggaaggggggcccggtcaccgcgagcgccgcagtccccgccccgcactcgccgccccttggagccgccgcggccccgcccgggccctgcgctttcatcctccccacgggacagcggccgcgcggggcgggggcggctctggccggcgcgctcccggcggggtcttccttccctccggcccctccctgggaacccgagatttcgccgcagagctgaactcccagattttaaccccaacccccccgggcgggaggccgcggagaaccgggagtcgcgaccgaggaagcgtccccagtcacctcctagccccccacacagagccccggggagggtgaggaggaggaagagcgggaggaagacccgcgccggtgggtgggggcagggagggggcgtccggggtcgcagggcggcgctccggagagtggccccggcggcgtccggagtcgctgcggccgccgtgccacctcgggcaggtgggggggggaatgcgcggccgccgccaaccagggtcgctccgccgtagacgccgagcagacgcggtccggcgctcggccggagagccggctaaggggcttttcattagcaccgcattaggaggacactcatcctccagagtccttcccgtggaagctcttgagtgaattaggtaaatgatttgctccatttgtagtttctgaagatattttctcagatcttcaatcgagcgctttagccggggagcatatctgtgggggcctccttcccactacctagggtctcactcggtgacaattgctgagtcagtgaggacgtgtggggaaaggtaaaagtggaattgagcaaagctgagtaatttagctaaggaagagaaatcgctactgaaaatagaatagtttaaaaataaactacataaagtttattcttttgcttggagtcctgctccttgatccgagaaggtaaaatccatcagagttgggagttccctcccccccattagcatttattacactttttcaaagttactgaaagacttcttttagtgaattttaagaagcaatcgtggttgacattacaggcatcaaaggtttggggaacagatgggtaaacttccgaagagcttagttgcaacactagctctcaaatttagtgtcaacttttattttaaaaaataaaatagggtggtgtttttattaaacttttatatttcaagaggtagagaacaccgaagaggaaagagactgaagggaaagtagggtgttggaaacaaaaagagaaaggcgagattgactgtaacattctggtcttcaacgagtcccaagttggaatcctaaagcactgcatatttctggtagcgttaactctaactggaatattggcgggcctggtctctaagtgcgtcctaagaaaaaacagatttaagcaaaatggttttttcccttttgtgaagggaaaaaatttaagcacttgcttcatgcggtagccccagcggaaaagcgagccctcccgctcccggtggcctgaactgaatttgctgctttaaaatcggcaggtgtgcccagcgttcccagcgctgcagccgggacctgatgagtaagagtaagagggctcaaccgcaggacatcacatgccgggtacctaacgtcggcatttaagcagacagggactaatatgctggaactatcctcccgacactggcaaagcccagagaccgcatttcctaccactttgcccactttgtactgggcaccctcggtaaacaggatgaaagcaacatttttatcccttaagacgaaaatgtaacctttagaatactccctattccggggttgacagcaggtcaagggctcagaggcaagcttgcattacacataggacaagtacaacttatcagggtgcaaaaaagggcaagaaactttgtaaaagttggaatcagtattcaaagagatagtttcaggtggtgctacataatggcatggtaaccacaagaagaccagaaatgcttggagtgcatttctgttctcgaagaggggttgagggtagaggcttggtgcactgtggtttgaaggtttacagaaagcagccttatcctcatgaagctgggaagctatgctttctccacaaaatacttttaatgattttcgccccagagataccgggatccgagaccttcacaggctctcctggcctgaggaatcacaaaacttgcaaactctgcagtttttcccttgagttcactttaaaaacacaggcaccttgagcacaaaacaattaaggtggtggtttccccgagacaacaaaccaggcacaaacacacaccttagtctgcactggcactaacattcccactctagggccactcactgccagttaaagaacaagagctatccacttcaagtgtggggacaagcttcattcagggtgcaaacacatgcccacaaaacacaaaaggggaacggttactccaaaagaagtctgaagacttccagtaagcagtaaagaacagcccggaaggtctgcaacctgtcagctccaggggccgtcaccactccatcctgtagccccacagcattgagtgctgtgtttcgaaaattggaaagtgctgggttttaattggggctgggtcctgccttctcccctcttcctccagatcgggccctctctgtaagcggatttgctttcccgtgtatcgccagcaggtcgtttttaggcaatcttgcttctgcaaaacgttttaaacatggtaatatattgcagtcttattaagtccccctccagaagtgggtgaaaggggctctgttttcctgaaagattcaggaactccactgtctgagcaagactagcccaaggaaggcttggattgactccgctatccacttaagtgaagacagtatttttgttgctgttgttgtttttggtttatgtttgttttttgtttttgtttggttggttttggttttggttttgaatgcctaggagattttaaattcacataatcctccctccaggaggaaaaaaaaaaaaaacaagaaaacattgaacttgctaccttcattataagccaccctagaagaagctgagaggacaggctgctgaactggtggaccacgaattaatgtggagaacgaggccgtccgggctaggttcccggggctcaaagacgcaaagggaaggcgacaaaggtttctcacaggtcgccgttagggagagggggcagcgcaggaaacccgtttatttaaagttcagttgtgttgggcatctgatccaggacaactcgcccaggagcccggcgggtttcagctgccaccacgaaagtaaggatcggttctgccgcgtcgccccctccttccccttgggatgtgccaggcgggcgacagataagggggcgcggcgcggggtcagccaccgagccagagggcggcgcccggttgcagcgctccacagccgcctcctgcagcctcgcggtcgtgaccttgccgagcagctcctgcgcctcaggctcggtccctgcacccgccctcactccagtccctctcagggcctgcagtggaagatccccgtggtccgggtgggtggcgatggagagcagaattgaatttatttgctctcaaattcccctaaaagctctgaaactgggaaagtccgcgggctgccagggacagtaatcactgtgtccccacccggacgcaggaggtctcgggaggagctccgaggccaagcgcccgcgacttctgggtgccaggttgctgcagacgagaaatgaagcccgccagatttgggctcccgaaattttttgaagtatgagtaccttagatttcccttctgatacagcgcctctttcgaaggggtgtgtgcgagtgtgatagtgaagatggggtggggagttcttgcctgctaaaaagtctcaccctggccccacaagcgagcaagggggagacaggcaggtggaggagaaggtagcacaccctcttctatttttattcattattttgaaaattgtgtaagattgatcaagtggagtcctacgctcacgcccagcgcttggaatgaatgaatgtttctctcggcgctctcagcaagatgctttctactaatggagaactttaccccgggtcttgcaacccactaaacttggcgtcccatgccacactgggcgtcccaggcctgcctgccctcgacggggcggtctctctgccggcccctggtaaaacagttactgcacctggggcttcgcagagtgcaaggaggaaagaagtggggcattactttccaacaagcaatgacctcagcctgccagcgcctaccttgttctggaaacacctaatctctgcttcctctataaagtttaactgcagcttgcctccaatcccaaattgcaaacactagcagaattgctcccttaagcatttccttcctttgacccttcctaaagccttgttcaagtcagcactctgggggtccttaagagaaagagaaattcaggatggccttctttcagtttaaactaataatgacacaaagggagcatacctgagtcctgggattgtttatacttcttcataattcagtgacagactaggcctgaggtaacaagttgtgtaggaaagaaagcattgcaacaggaacatggcttggaaaacttctctccaaaggaaaccttggcttcctgccacctggatagtcacacattaataagtatgcacttaacatatacagccaacattacatattagcattgatctggtcaagtggagaattctccatagttgcttaactattccatgtatgggaacagatttggtagggaatgttctggcctattcttaataataataaagactgctgagctccttgcttcacactgacatcataaaagccagataaaataaactgcttagaggcctcagtggaaatccaggagcagttcaaagatccccctattatatctgaccttgctttccctgtgtttacattggagtaataataacctctaagattcattgagctgtttgctacatgtgccatgctctgctctaagcactttaatatgataactcatttaattctgacaacagccctatgaattagttgctgttttaatctccatttaataaatgtaggaaactgaggcacaaataaactaagtaatttgcctactactacttagcctgtgcatgttaaaactagctagttgtttggctgcagcacctgtgctcttgaccactgactacacagacaagaggggttttgaacagtgatctctgcatgtgatcctgcttggagctgttttctgaaaaaagtagacaggaagtaattaatcccattaatttggtacatctagacagccaacctggcatagaagaactcttacccactgaaaagttactttccataagctatccaagtgattcaatgcattttatatacagatcataaataaacaagaacattgaaaattgttccattccccatatccttttggttggtccttgaaaatggtctttttcccctcccccagaaaatatatgattaaattgtcattctcaaagagcactcatacactgtatgtattgcagagctaggacaataacagctgttaatacagacaatcttgattgttaaggacgcatgcatactggactcatcactttcatcaccttcagtttaaacagatgccacctgaggaatatgacctctttttctctccacattaaccccctcccccatcattattccctcttaaatagaatcatggattgtctgtgcaaaaaaagactttagaaaccacatcatttaccctctgcaattctacagatgaggaaagggtggggtgggggttgggggcacagaaaaagaaagacttgccagagcttacaaggaacccaggactccgtatttccagttcactcagttcagtctacttcccccaaaccagattgctccttagagttgataaaaagtatttagactaacagcacactttaaaaaaagttttaacaacccttttttggcccaagatacataaagaaggggctgtcttactcctttcttcctttcagatgtgttcctggaatgtcttcaccagatgtttactcgagaacttgcaatctcagtcttcaacatgtgagcgcattttaagagcagtattttagatcggaacccaattaatgattttttttcttttttaaaaaagggaattttagtttgcttgcaaatgatccgagtctgtagagtctttacagactctgcgttaacctcagtcaattccactctaggacgtgctagtctcacagtctagttttgttcagactttattttgcgccaagctgcattacagaccacttgtccaggctgcaaaaggttggggtagggggttggggtgacgggcgcttcccccccgcttcatatacgtgaagcaatctggaatcattccacttggctctgacgcgcgcgcgcgcacacacacacgcgcgcgcacacacacactctcacacacacgtgtaccgtgcatgtgtgggcgcctatggatctgtgtatgcgcgcgtttgtgatttaaagtgacaggaccaagaactggctgaagcagagaattgttttgcgtgataaatcaacttgattgtctccacactgtacttccattattcacccgagtgctcggtggttacggcggacgtgcactgcggcaaaaatgtcctcggagccgctaattttgtggccactgcggcggctgcggcggctgcggcagcggaggcgcgggggcgcgagcacgggttgatttttcaagatctatctcctttagtgcaactcgccaaatggaatcgagttgacagcagaagcctcacaggatgcgtgtggattgggttttgtgcctgtgattttttaaaaaaatatattttttatttgtggagaggagccgagctgttggcgcaagaagggaaatataccttttctgttttatttcccctttattcccttaaaaaaaaaatgaaaatggccaccaccgtttcctgagctttcaggaggccagacctttgcagatggggaggtgacacttttttttttttttttttagacggagtttcgctcttgtcgcccaggctggactgcaatggcgcgatctcggctcactgcaacctcgcctcccgggtacaagcgattctcctgcctcagcctcccgagtagctgagatcacaggcgccggccaccacgtctggctaactttagtagagacggggtttcaccatgtgggtcaggctggtcgcgaactcctgacctcaggtgatccactcgcctcggcctcccaaagtgttgggattacaggcgtgagccacagcgcctggccggaagtgacacttttaatctgtttcttacctctgtccctccctccctcacccacctccacctcgtcagctctgcaacagtccagggagagaaattgtcataggcacttgtgccggtcatttgttttcactcgcttttttcttctgacagtagttaccaatttttttcttttaaaactgatactttttgtctagttatcaaatttttaataaatatatgtccagaatatgtttgatttgtcttcttaaacaccaacccatgcagtggctgaacagcagcaggaggcaatctctttaccagatctggtagagatcacctggggcagacacaactcaatagttacagacagttgttttttttttaatttttggaggaaggtggctaatttacaaattaatttctagaaatgtgtgttgatgcctgtgagtttatttaaaaacacatacagaattttactttcatatatttattattgaattgctattttctgtagctgagcatatggatcacaccagacataatttacatttaaaaagtgggattccaaagacttgagggtcagctgtgccacccaactttgtttgcaggacaaaacctgaatgttttttgagggggtgggaaaacttttccattcataaagatggcattgacatatttatcctaggtttttacctctcttgaagctgactacagagccatagtggtatttgtcaaattgggaagataattgcagtgtgaatgtgtgagtaatgacacagtattgcataataataacttaagcagcatatctttgtttacagtgatgtaactttcccaaagtttatatgtagccttaaagggtttagtgcagagcggattgcaaatgagtaactgccaagaagaaagaaagagggtgatccatccctcccagttagttctgcagtcctcattgttatatgaaatcccaacctgcagataccaggggcaagaggaccccatttttcttgaacagaagggagagattggaaagaggccaaactgatgaccttaatgtatttgataaagttggcccgcattgtccatgatatgaaaaaatactcctttttaggagaaattaaaaagctagatgtagcaacacagtgaaaatccatctcagttaaatgtgaatatatacccagtggagtaagctattacaacatagttgaaatatagctttttttttttttttgactgagtctcattctgtcgcccaggctggagggcagtggtgcagtctcagctcactgcaacctctgcctcctgggttcaagcaatcctcctacctcagcctcccaagtaattgggattacaagcatgtgccatcatgcccagctaatttttgtatttttagtagagacagggttttaccatgttggccaggctggtctcgaactcctgacctcaagtgatctgcccacctcagcctcccaaagtgcctggattacaggcgtaagccactgtgcctggccaaaagacagctttttttaaaaatgtgcttctaaaatagtgaaaatgagcccaaatgaactcaccaccaacaacctcattttctccaacatttaaaacatacttaatcggtcctgtgtttggggtactgtttcacaactcataatttgtaaaactgtacaactttcatgttaccataacttgatgagtttttttttgttttttttttgagagaggtctcgctctgtcacccaggctggagtgcaatggcacaatcttggcttactgcaacttccacctcctgggttcaagtgattcctggtttcaacttgataaagtaggcctgcattgtccatgatgtgaaaaaatactcctttttaggagaaattatagccatgcctcagcctcatgaggagctggaattacaggcgcccatcaccacatagctaatatttgtagttttagaagagacagggtttcaccatgttggccaggctggtcttgaactcctgacctcaggtgatccacccacctcggcctcccaaagtgctgagattataggtgtgagccaccaccccagccggatattttaattcagccattacagaagagacaaatggaagtaggtcaacatctaggtccacagaaaggcggcctacctaccaactcaaaggaaacccatactgtctcccaggcaccaaaacttccactgtcttttttcttaaagactcacattccagggcctcagagtttgatgtgattctgacttatagctacaaaagtgataccaaaatgtttaaattaaaatatgaacatatgaaaactaacaaataagcctttgttggtcattaagcaaggccctaaactcatgaaatactcccctaaattctatcagaattaaaactctttgtgatatcctcagtagaaccatgattcaccattacagagactatagtcagaccacagagttaatttttataaactttcttggtatagattttttttaagcaaaaaagaaatcacaaaaatagctttcttatagaaaatgtttagtaaaattcctaatatgctgctgctgtagaccgttttgctaaactgggcacttcgtttaatgacaataataaatatctgaatagtataaacattaactatggtattttcttagttaattggttatgttcttatttttaaagcaacataaaacatcataggaaaatcttcagattttaccatactgggattgctctatcaatgaagtgctttttaattttcaacttatgatttatgtgttaagctttcatattatcaattgtaaaaaaaaaaaacaaaactgagggttttttactgggtgcacatcaaagttaacataattatattatctatagaccatgaaagtcatactattgtacctaacatacacacggagacaatttacaatagtaagtaacattatgcaatgttacatttttaaaaaatggaagcaaaggctttgaagaaattgaaacaactggggtgatcaggtaacaatgtaaaagcaatacagacacaaaactatgagattgagtcattattcacatttagatttacatttacatttacaaaagaaaaaaagagaggatacattttattttattttattttattttattttttgagatggagtctcgctttgttgccaggctggagtgcagtggcatcatctccgctcactgcaacctccgcctcccagtttcaagcaattctcccacctcagcctcctgaggagctgggattacaggcgcctgctaccacgcccggctgatttttgtatttttagtagagatggggtttcaccaatttggccaggatggtctcgatctcttgatctcatgatctgcctgcttcgacctcccaaagtgctgggattacaagcgtgagccaccgtgcccggtgaggatacattttataagcctttcaatacctctccaattaagaacatttagcttgggaaataacaggtgtctgtgtcaatgctattatctactaagaaaaactctctcctacctatgcttaaaaaacaaacaaaaaaaatcgggccgggcacagtggctcaagtctgtaatcccagcattttgggaggccaaggtaggcagatcacaaggccaggagttcaggaccagcccaaccaacatggtgaaaccctgtctctactaaaaatacaaaaattagctgggtgtggtgacgtgcccctgtaatcccagctactagggaggtgcgcacctgtaatcccagttacttgggaagccaaggcaggagaatcgcttgaacccaggaagcagaggttgcagtgagctgaggtggcgccattgcactccagcttgggcaacagagcaagactctgtctcagaaaaaaaaaaaaaaaaaaaaaaaaattcaggccaggcatagtggctcacatttgcaagctcagcactttgggaggccaaggtgggtggattgcttgagcccaggggttcaagaccagtctgaacaacatggtgaaacctcatctctaagaaaaatagcaacaagttagccaggtgtgatagtgctcacctatagttccagttactcgggaggctgaggtgtgagtatcacctaaacctgggaagtcaaggcagcagtgagccatgatcgtgccactgcacagcctgagtgatgcagtgagacccagtctcaaaaaaaaaaaaaaaaaaaaaaatcaaactctttaaatagcacttcttgtaattagcatttcaattattggtaacataaaattcaattgtcttctcaaattccgactttgagaaatgaaattgaatattaataattatttttaacatgggttgaagcaagtatcacacatattacattttcagaatttacttgaatattatgctgtcacatcaggacataggatttactgtaatctgatgttcaaataagaattccaaaagatagtcctactaactatgaaactggatttggaaagagagaagtgaggtagaacgcaacccattatttggtgcaaagtcatgtgtcgaatgttgttagcgacccggaaaaggctattatgctctggccttatggaaaataaggtaatctagccttgtggagaatcacttgctgtttttaaagaccagcttgccccttacttttcctgtatgcccagaacccagtgtaatacctggcacaccaataacattcagtaaatattttacaaactcgatagttcaatttatttttaaaaaaacgttaggaagtataaattttggtagcagatagggctagtagaaatactttggcagaagacaagttgggaatttcttttctatctgccatctcctgacaaattaaaatatgtttgatttattgtcaattttatggctcctgcaaggactagcaaactaataggataatgttaaaaccagaaacattcaccattctttggtctctttctttaaaaagtacttcttttttcagtatactataaacatactaaggacctaacaaactttcatttttcagctttcagcctggccctgcttacaacaaactggccatttagaacatcctcgccaaactaaagcactctttataattggttctacttgttcccatttttgttttctttccttggtaaacataaaaattatgccaaaactgccaaaatttattgaaggtaaatgccattctttccagcattattttactgaacaaggtattgctgatggaatgaatcttaatatctacaggaaaccaaaatattattcttgcatattaaaacccagagagtttttttccaaacaacttatttctgcattcatgtgatctaagatagaaaccaacttttttttcttggcccataaaacataatggccttcagggatcattcattgtttccataggtacccagctctgctgatgcagcacaactcttaacttgcagagtaaagaaaataataggtatattaaaaaggaaaacggtatccctgtaattttatgattttataataccatgttatttatataaataataatatataaagtcagaattagacttttggcatcccaattaagaaaaaaattccacttaataaaatatatattttctaaagtttttccataaaatataaggtattacattaatatgggatatttaattatttaatgttataaagaggataacaatttcccatcagaacttttttcttattattgtatttattttaactaatttttttttttttttggatggagtctcagtctgtctcccaggctggagtgcagtggtgctatctcagctcactgcaacctccacctccgggctccagtgattctcctgcctcagcctcctgagtagctgcaattacaggcacacgccaccacacctggctaattgtatttttagtggagacggggatttcaccatattggtcaggctggtcttgaactcctgccttcaagtgattcacccacctcagcctcccaaagtgttgggattacagacgtgagccactgcgcccagccctatttttaaattgagactgggtctcactttgtcacccaggctggagtgtagtggcgcgatcacagctcactgcagcctcagcctcctgggttcaagcaagatgagagtctcactttgttgcccaggttggtctcaaactcctggctttaagtgatcctcccacctttgcctcccaaagtgctgggattacaggtgtgaaccactgcgcccagttagaactttttttctaaattgctctaatgttatagccctaaaatattaactggcagactaaagacctgaagatgtgcatacattaccaaccacagtgagttcagccgagtagtttcaaagttttggtcacaataaaatggtgaccaaacatttttcactgtaaaaagtatagtatggtattgtttaccaagatgaaataagttagatataaatgtcttttgttccatgttaggctctgggacatcttgactaacatttccatatgtaaaacaaaagagaaggccgggcatggtggctcatgcctgtaatcccagcactctgggaggccgaggcagacagatcacgaggtcaggagatcaagaccatcctggctaacactgtgaaaccccgtctctactaaaaatacaaaaaattagctggacgtggtggcgggcgcctgtattcccagctactgggaggctgaggcaggagaatggcatgaacccgggaggcagagcttgcagtgagtggagatcgcgccactgcactccagcctgggcaacagagcaagactcatctcaaaaaaaaaaaaagaaaagaaaacatgagatagtggaggaaagaaattaaaggtagcttttttctgaaaccctgcaatccaatctttacactgctgtcagactgatttttctaaaaaaaaaaaactcatcttattaccaccttctttaaacctttcaatgactctacattgctgtcaggatacagtctatagtcttgaagttgatcactatggtcaaatgttctgactcatatttaccccttcagcctcatcttgatacctcctctcccactagttttcagtccagtttatttcttctttccactccagccttcctcctcccaattcccatagttcctggtaactcttatttctggttgagaaaaaaacctgctccagcgttcataaagtattcctgaaatgaatgaagaaatgaacggatgaatgcatataccatattgttctattatgcgtaactatagacctatggaatttctaataacaactttagatatccattagttgaaagatactttacagatgaggaaacccagagtggtcctgacaattcgagtgactttttttgtttttttttgagatggggtcccattctgtcacccaggctggaatgaagtggtgagatctcagctgactgccttccaggctcaagcagtctttccacctcagccctcaagtagctgagactacaagcacactccaccactcccagttaattttttttttaatagagagagggttttgccatgttgtccaagctggtctcaaatgcctgggctcaaacaatccaccaccttggcttcccaaaatgctgggattacaggcatgagccaccatgtcggggctcaaatgacttctgaagaccacacagctaacgggactatggggactagaatctgagcttcctgaggcccatgaaatcaactccataaatgcaacaagtcattaaataattcattcaatatttttctccaataagaaattaagattattgtttttttctcaaaaattaaaaatagccatatgatccaatgattccacttctgggtatatacatatacaaaataattgaaagcagggtctcagagatatttatatatccatactcatagcagcattattcacaacagccaaaaaggtttggaagcaaaatgtgtgtgtgtgttgttgttgttattgctttgttttttgtgtttttgttttttgagatggagtcttgctctgtcacccaggctggagtgcagtggcgtgatcttggctcattgcaacctccgccttccaggttccactgattttcctgcctcagcctcctgagtagctgggactacacatgcacaccaccacgcctggctaatttttgtatttttagtacagatggggttttgccatgttggccaggctgatctcaaactcctgacctcaagtgatccacctgcctcagcctcccaaactgttggaattacaggcgtgagtcactgcgcccagccaaaatgtttcatatgtatatatataaaacatagcttactataacatatatatacacacacacacatatgtatgtatatatgtgcatatatatatatgttcagtcaatgaaacattctgccttaaaaaggaagaaaattctggcataagctacaacatgtgtgaaccctgaagacataatgctaagtgaaatgagccagtcacaggaggaaaaaaactgtaagagtcaacttacatgaggtacctagagttatcaaattcatagagacagacagtagagtagtgattgccaggtgctaagagaagtaggaaacgaggagttatttaatggatacagagtcagcttgggaagatgataaagttctggggatggatggtggtgatggttggacaactttgtgaatctacttaatgccattcaacttacatctaaaaatacttaaggccgggtgtggtggctcacgcctgtaatcccagcactttgggaggctgaggctgatggatcacgagttcaggagatcgagaccatcctggctaacacggtgaaaccctgtctctactaaaaatgcaaaaaattagacgggcgtggtggcaggcgcctgtagtcccagctactcgggaggctgaggcaggagaatggcgtgaacccaggaggtggagcttgcagtgagccgagatcgcgccactgcactccagcctgggagacagagtgagactccgtctcaaaaaaaaaaaaaaaaaatatatatatatatatatatatatatatacacacacacacacacatctatatatatttatatatttaaaatacaagaggctgagtttgaggttatagtgagctacgattgaacaactgcactctaacctggacaacagagaacctgtctcaaacaaaaaaaaaagtaaaaatagtaaatgttatgttatatatatttacacacacacacacacacacacacacacagtcattttccaccagtacagggtcagactgccttatctcctattctgacccacaaaggctatgactgaaccactgcactccaacctgaacaacacagaacccatctcaaattttaaaaaaagtaaaaatggtaaatgttatgttatatatattttttcacacacaaagattgtcattttccaccagtacagtgtcagactttaccttatctcctattctgacccacaatacattttttttttcggtaatgatttcagttgccctgaagtcctggttcttaggctattaacagagctttgaggcaagatacccacttactgttacttgtatcaaacagcaataacccaattctacaacttcctttgttagagctccctttgctgaccccattttgagtcaccttacgcaagaaagacgtcaggacaggccagagagccaaaggaaagagattggaagagtctgaagccatagcgtccacaccaactggattgtccagtttctgcttccttcccctctgtactatttttgggaggtgtaatgtgatcttaggaatattagagtaagtatgaaaaaccataggggcggaggggtcaatgccaactagttctgtcccttctttgctgctgaattctaggcctttccattagcccatagcactcaagctacagctgagtcatttgagtcatttgagaatattcattgagaatagtcatttgagaagattcccatccttcccactccctctgtccttatgttggctggactctcatccagggctggagtaaatggttcagtgcatcacagtcaagactgttttcttcatgacaacccaggtctgtgtggcagtggtgaaggtggtagtgggaggttacatggtaaattttctcagacctcagaacatctctgttgctttcgaataaactttcttgaattttgtgggttttcttgtttttttttttttttttttttttttgcggggggggggttttgtagacagggttttgctctcccacccatgctggtatgcagtggcagaatcacggctcacttcaccctggacctcctgggctcattctcagccttccttgtagccgggaccacaggtgcaagccaccaggcccagctaatttcttcatttattttcaagacaaggtcttgctctgtcatccaggctggggatcggtgcaatcaccgatcattgcagccttgacctcctgggctcaggtgattcttcccacctcagcttcccaagtagctgggactacaaacacatgccaccatacctggctaattttttgtattttttgtaaagacaaggtttcgccacgttgcccaggttggtctcaaactcttgggttcaagtgatcctctcacctcagcctctcaaaatgttgtgattatagtgagtcaccttccctggccttgaattttataatcacatggacattgtgtatttcataaattttagtttttcctctttaaattattaggaaactcaaagtcaaattttaagtcaatgctagcaaagtaaatggaatcttattgcatatgttttgaatcttactctcaatttcacctcatttttatcttgatagactttgtgtatgtatgtgtacacacctctactccaaaacctataaaatacaggcaggataaatatgactagctaaaaattcaaattatttgttatatatagtcctctattaacaactgttggtggtagaggtattgagggaatagaaacttacatattttgaacagttttacattcatgattttattgaatcctcaccaagccacatgaggtaagcagggctgacaatatttacattttacagtgggcgggagatgggtaggatgtcagggaaattaaactgtcccaaggtcaccaagagtaaagaataggaaagcatattaagcccacaactcaaaaattcaattcacagcctggcacagaggctcatgcctgtaatcccagcactttgggaggccgaggcaggaggattgcttgagcccaggagttcaagaccagcctgggcaacataatgaaaccctgactttacaaaaaacacaaaaattagccagctgtggtgccgcgggcctgcagtcccagctgcttgggaagctgaggcagggggcttgcttgagccagggaggttgagcctgcagtgagccatgttggtgccaccacacaccagcctgggtgagagagagagaccctgtctctaaataactacataaaattcaagtcactactctctatgttacagttctagactgtttctctcactcctgcctcatttgtttttcctgaaaaattatcctttatctgtctaaacatgtttgggtaaatcttcaagtgctagcctggattttatagccactttttcagtttagacaattacccattttctttcttctatcagatctaccagcagtatgtcttcactttctcagacctcttttctatgttgataccagagacagttattcacgcctttcccattcctgcagaatatcctttgcatgaagtaatgaaactggcactggactggggatgaattctttaccaactgtgtggccatgagcttgatacttcactgtgctactttcagttttatcatctgtaaaatgtggtggttggagacttctgagttccctttcagctttctgcttctgtgaattgtaaactcatactttgctaccttttatttatttatttatttatttatttgagatagagtctcgctctgtcgcccaggctggagtgcagtggcgtgatctctgctcactgcaacctccgcttccaggattcaagcgactcttgtacctcagcctccggagtagctgggattacaggtgcctgccaccacacccagctaatttttgtatttttagtagagatgcggttttgccatgttggccaggctggtttcaaacacctgacctcaagtgatccacctgccttggcttcccaaagtgctgggatcacaggagtctccaccacacccagcctcggcctttactttagtcaagattttttctgctggtcatctcagcagctcagttgaatatcatttttcaattggacatcatttttggtcttctgcagtttattgtggtgtgtcgaagataagaaggatgcgaccatatgcttacctttgattatgattacagccagctaaccatcaacattgtattttaaaaaactgaatcctgaagcctttcctaaggcagatacaatggcgagagctttggggagcaattctaaatgaattaaatattctatttaactactcattaagagaatgactttgagtaacaaactccccatagttttctgagccttagtttcttcatttttgtgatgggaatgacaaagtctaagccacttatgcagtaggaaggttaaaggtgatgacctgtgtggaaggcctgtgaaaggcaaattcaatgccctgctagttatactgacaattccacccttgtgataatgccctgtcttgcattagccatactcctgaccttgttttctatcagaacgcaagtctagaaaaagtaaccattgttcctgtcatttacatattaattcaccaaacatttactgaagatctactgtggcactttgcttataagctttcaaggatgaataaaataactgcattttcaagaagcccatagctcagtggacagacacacaaataaataactgatgtagaatgtgaagagagcggtcttagatgagtgtaagatgttagagaacacagaggagattgaccaattccgcctatgggagttgggaaacaacattaaattggtccttgagaaaatgggtgaaacagggagacaacttcagggtcttctgggcaaaaagaatcatacaaacaaggaaaaagagggatgaacatgtatggtatatttgggaggtgataaaaagggaaaactcagtcattttttgtggctaggatgaggaggcagccgagagagactgagcaggaggggagtctggaaaagtaggctgataaaaaaattagatatattatataccaaattggagaaaggccatgagatttcagagagaaaacaattcaaatataccatgagattgttttgtaatcttgattattagttatagagaagattaggctgctgtatcggagacctgaaaacactgtagcttaaaaaaaacacaactacggtagcctaaatataatctatgctggagaagcggctctgctccaggaggttatttaggaacgcaggttcctttcatcccgtagctcttttgtctcccagggaattgtccgggtctttgtagttgaagttggtatttcagtatcattgctgtctttggaaagggccacaagttcaggacaaatctatctttctttctttcttttctttcttttctctctttctttctttctttcctttctctctctctctttctctctttcctttctttctctttcttctctctctccccttgctgctccccaccacctttctcccttccttcctttccttccttttccttttctccttccctccttcactcatttctttctcctctttatcttctttctcctctttctctctttctttctttcctttttttttttttttgtgacaggatctcactcttattgcccaggctggaatgcagtagtgtgatcatagctcactgcagcctcaatctccagggctcaagcaatctcctgcctcagcctcctgagtatcagggactacagatgtgtggcatcatgcccagctaaattttttatttttattttttgcagagacaaagtctatctatgttgcccagacttgtcttgaactcctgtggctcaagtgatcctcctgccttggcctttgaaaaggctggggttataggcatgagccactatgcctggcccaggacaaatttcttttaagcaagtgtcatgaagttgcagccaacaattctgctcacagaacttaatcatgtgtcatatttagttgcaaggaaggctaggaaatattaactttatttttattttattaggattttattttaataggattggttctcaaacatggtagggagggatcaaactctcttgaggaacttttttttttttttttttttttttgagctggagtctcgctcctttgctcaggcgggagtgcaatggcatgatctcagctcactgcacctccgcctcccaggttcaagcgattctactgcctcagcctcctgagtagctgggactacagatgtgtgccaccaaacccagagaatgtttgtattgttagtggagatggggtttcaccatgttggccaggctgatcccgaacacctggcctcaagcgagctgcctgctttggcctcccaaagtgctgggattacaggtgtgagccactgtgctcagcctaatattgactttaaatagctcatctgtgtatctaagaatagagaaagaacagatttgggagtggggaggcaatagtctgccacaacttgcttatttgggaacctcatcaattcctagattaatttcgcttgtagtgtttatcatttatattgcaatgtgtgtcctttgaatgcctgtgttgattactttgtctaaaaagtgatttgaatgatctaggatttatacaggcaaatcaagaaaatgtgaaatatatctctgtgtgtcaacattcaacttcgttcacaaattaaaacttaagttgattattagaaaaatattgcaattttgaattatgtttctaattctgtaaaactctaacattctagtttccatatcaatgtcttgcaagaggattaagtttttatttgggtcaacaaagcaaaattcctggaagagcctactattttcaaggcataaagccaacctacacagaaacatgaggctctcaatggggttagcaacccaaattcaccctactagatttgcacctgatttccagtggcatggtggagccaaggttactggaatgcaaattcacaaaggtgggaagaattgatgtagtgtaaacgtttaagccatgtgaactactattactggtattattttaatattatttaatattaggtttaaggatattagaagcagcaatttgtggagtaagtagagcctatttcactaacagatcttattatacatcttctggctatttgaattttgagaagagtctgggaaaaatttactcctaaattgcctctgttgatcaaagtccccgaaaaccagtatcagcggagggtcttccttgtttccttacctctctttcatgctctactccttcttccctttctctctttttctcattcattccagcggtgccatagctcaggactgcatcttttctcatatctttctaaccactctctttgcctccactactagaatgatatttctaatttgtaaatcttattttgtatatctcttggttaaatacagcccctccagtgaaggttcaaagggttcacaatgctctccaccaccttggctctgcctgcctttctaaggtcatctctagttacagtaatactgtccagtgccgcctaaggacgtttcagtcaatgagagaccacagatacaatggtggtcctataagattatataatactgtatttttattgtaccttttctatgtttagatataggaatgcttaccattgtgttacagtagcctataatattcagtagagtaacctgctgtacagagctgagcctaggagcaataagctataccacatagcctaggtgtgtataaggttataccatctaggtttctgcaagtatactctacgatgttcttacaacgactaaatcgcctaacaacgtatttctcagaatgtatccctgtcatgaagtgacacatgactatacaagctaatcctaactagacaactagccacaattgaatacatccccattctttggcctgttgcatacactgacatcattgcgttttcctggagaggaatgccctgcccctcacctgtctacctgactaatgcatatttctgtcccaacacaaatgtctcttttttaggccttaatgactgtctctgccttaatgacccagacaaaatgaatcattctatcaccactgcccattttatacatatatatgtgtgtatatatatatatatatatatgttggacataacgcttattacattacactattagttagctttatgtcttatctaccccattgcactgaaagcttgttagaggcagggataatgtctcattctttgctgtatccctagctcttagcaccttcaatgagcctatattgagcacacataatgtactagttaatttacatatgttatctatctcccattttccagatcagaaatctaaagcttgcagaggttttgcctgaaaaaaaaaaaaatacacatggtagaaccaacattaaaacctaagttgaggccaggcttggtggttcacacctgtaatcccagcactttgggaggccgaggtgggcggatcacaaggtcaggagattgagaccatcctgcccaacatggtgaaacccggtctctattaaaaatacaaaaattagccaggcatggtggcgggtgcctgtagtcccaactactgaggaggctgaggcaggagaatcacttgaacccaggaggcagaggttgcagtgagccgagatcgcagcactgcactccagcctgggcaacaagagcaaaaactctgtccaaaaaaaaaaacctaagttggactctgaagccaatgctatgttgtcaatgctatgttgttgttgactagatggagatataaaaggtcactttggaaatggtgccaacctaccatatcaaactgagttaatgcactacagacaatgcacacaaaattcactgttaccacctacttacaaggcctggcctgcttagcatcagagattattcagaccatagtatctacagagcaatgcagtacaggttgacacctcttctgcatctcaacggttcttaccttttgacaaaaccttccactctcacaataggttgatgtcttgttttacaggtgttatgtaaccatctcaaggtcacacagtctagtaccagctaaaccaggcccaaaacttttttttttggttacttaaaaaaattgttattattattattattgtatttttagtagagacggggtttcaccatgttggccaggctggtctcgagatcctgacctggtgatccacctgcctcggcctcccaaagtattattttttatttaaactgaagccgctacatcacatcaagtgtatttctaggtgagagtagtacaccaagtggaaatggatgctcagtggaggaggctaggattaaatgccacaggcttgctacagccaagagcatatctgcatctatgaggggcagaccagaacagcaaagctaatgccaaggccagccacagtacggctacatcagtcgactagttgtagagagcaagaccgaagcaaaaaatgtgattcaacataaaatatgaggtttctctaacctccaatttaactatgcaaggtcctgttattaattaattaggtaccttcaccaaggacagttaagaaaatcagacaactgccaggttgcttcctattactcttgacttcttactggatacttttaatcaagccaggtaagcacacgttttcctctaagttattcagcaaaatgtcctatgctccttaactgactcaaagcaaacacaattttttttttttgagacagagtctcgctctgtcaccaggctggagtgcagtggtgtgatcttggctcactgcaacctccgcctgctgggttcaagcgattctcgtgcctcagcctcccaagtaactgggattacaggcacgcgccaccacacccggctaatttttgtaattttggtagagacggggtttcaccatgttgggcaggatggtctcgatctcctgaccttgtgatccgcccacctcggcctcccaaagtgttgggattacaggcgtgagcgaccgtgcccagccagcaatcacatttttaaaaacaacaacgaaaaccgcagtagcctggttgtgtgctttccatttaaagagataactccctcccttcagagtcttatttccttgctctgcaccaatggctattttgttgtttaaaacaaacacttaaactgttgacattgaaatatccagactacatggtcttaaagagtctgggttaatgaaataaggtgagtcagtgagatgaaggacttaatgttccaataattatcttttaaaaccccccttttaaatgtcaaaactcttacagctcttctcttaggggagtaggaaggggaggggtctcctttaattttgtggaacccaggttttgtaaggatattgacaaattagatgcttggcaattaaattagaatttcaccgtatctcctgccttaaaagaacagctttattcttgagggagcccacctaacaattttatgttcagtcatctgcagagaatagagccactgtctttttctttcctaacctagggtagacgctttatttcactgcaagttccctgtgacattttgcactctcttgatttaatgcaccaaagaggatctttaactcttggtctacactagtgcaaataaaggttaaatctctcactaaccatcatgaactagcctaataactcacgagaggccctggaaaaagaaaccgagagagcaggtgtgcagacttgattaaaaggtgcaaaacccgcacaaccgcaggcaaaggtactttatcctcacgttgcccagtaccggctgcgaggtgcgcaagcaggggaacttgtactgcgccaacagaacgattccgagagccgggcctagtaacacaggggcttttcttcagaacggtgtccagaccggagcttgcgccgaatgtaggggctcctattggccacgcgccgtaggggaggagacgactggcggggagacagactggaggaggggagaagggggcaaggccttttccctgccccctccctgccccctccgccgcaggctgccgccggtacctcgtgcgtggttactatgcaaattgcagcgattgcggaaataaacaagggagttgggagaggagagagggactgccgaatcgattgcaacttctgcaaagtctcgtacaatccaaagcacgcaaggcaaaaccagagcgaatctgagaaccagccagcccgggttggatcgctttcaaaagagagagtgagagcgagcgagcgagcgagcgagagcgagacagtgagagagggagagagcgcgccttgcaattgcaaaagccttctgatttggagttaaaaaaaaaattctccaagaagcctgcaattggccaacagctttttaaaaaatctcttccgggttttcaacggttccaagtttatttagatattttttaaatgcaaaaaaaaggggacaacaaatgaagcaattcgtctgagcattttaaagtttctcacgtactctttttacattgcaatggtacgtggtacatcttaaactttctattttgcatttatatgatatgcgttttataaacaatggtagaatgattttgtttaatggctaagactaaaatttctctagctcgcatatgcacttaagtgattgctgggtaaatgtctattgtgatggttttgttttaaagatgtagctttgttgatggtgtttttgctatgtgcatcagagaccgggttttctttttcttttttttttttttcgggatttgaaaaaattgctgagcttgacagatttttttttcctcctagcgcttgctcggttccagaaaggggtggggggaaatcctgtacgtgctctgttctgtaaaagacgtctggcctcagcagtcaacctaacccgaaaagaaatgtctggacccggagaataattgacgatttgatcctctaatcaatgggacaacttgggagattgacaaaagctttatccaatcataaggaagcttgggtgtacaatagttctcaatagccagagggggcggggcagaggagatctgaagttctctgcagctctgaaggggatggtgtggttcaagctgtcaaagctacaagcgcttccggatttagcaagcacaataggaaagaattttcgcgtttaagaaaaaaaaaaaagctgatcgggggagttttgcatgaatcgtgtgccttcttccttgtcttttggaaaaagaaacattctgctagagaaataactttgtattgttattaactttgcattagctattatttttatgctcagggaagctggtaacttgtggaatgtgaagttcaactttaagaaacgtgtggcttaaatcttgcctgaattgtgggactgtagtgagctttgggaagtaatatattgcgtattcagcattacaaaacttcttactctgattatcttagaagctttggcatttcaagtactttgaaattaataggtaaacctctcttcttgaactctaaacaacagttttaaaggagagaatgtttcacatgtggactagcagctgtcttacacacttgaaagaaattaggggagtgttttttcttggctattcttgaattctgctttttaagtatatggtcagtaggaaataggacgttaagactggccaagttcacgtttctccttgttaccacaacaacccccgtggagagtgtatggaagatcgctgacttgctaactgttagttggagtctggcctcttggacaagtgcttgatacaaatccagtggaaaccaactgcagtagcttgtcttggagacagtaactggcagcctctgactaaaatatctccatctcctcctctctgagcagcgtagacacccaattctgttgggaagtgaatggaaaataatatgggctctttcccttctttggattaaattcccatcgagctatttcccaaggctttaggccttccagtcaaatctggcttggaaatttgatgtaagaattcacttggacactcacttcagcaacatgattcaatttaggattatatgcacataagaaaaatctgcacagaagtgaccagcaggtcaaaaaccagagaagaaaaaatgttgaaaaatgccagttaataaagttagttttggtaagaactacagagttatggtgttgtcgcttatgaatcccagtcctatcttcactgctttgggtattaaaatctaaatcatattaataagatctccctattaagtaacctccaaaatgagagctatttgagatgtacatataagtgaaaccttattgacgtaatttatatatctaagaggatttcactaaagctggcaaggtaacgtttctgcaaataaaacacagtaaatgcaaggctgggctctgtgccaggaagaatatggatagcagagagcatgacaggagcctcctttgcgcagagacaatcccatttcaaggcagcctcctaccacttggaaaataaatgattggagaggttatttccaataaggggtttatccttcctaacaatgggtcatttatatgattgcagtgaactagtttccatacttcacctgcgtttcctccactgctctctctactatcctttctttcttccctcctcctccatccctgctctctctcaagtgccttagtatctttgtgaactctggacaaggatttacttttgcaacttgggaagaggggagagggttggaaatgttttttacccccagtctgccctttgaggaacatctgtttctttgtgcgtgtgtttaaatttatgcctgttggagagaaagttaccagaagcctttctgtaactgtaactcttctactgtatttttctcagtcttgtttccaaaggctgtagttggaactgtgctttgtagtgttcccccgcctccccccctccctccgcgggggagggagcgggagctggcggagataggagagaaagcaggagcggatgtgaagggctttggtgctgaacttggatccagcccttgcctagagggcgcaaacaatcgtcccatatccaaaagtcttacgaagggcgccaaaagttacttaagataatattgctaaccgcagaaagctggaaatcgcggggcacatccactgctgcaacaaaagaagtttttaaagtagaaatatcagcattaaattacttcccccattaaaaaaaaaaaacagggcgacatgccagtcctttttaaaaaaaatcttttttttccttgagactcaaaagtaagaatctttgccgttttgaaaataggcagatgtgaagtgtatcttttaatacaccaaaagaaagattttaatctgctctggaagagagcttcccgagtacacactctgaacaataacttttcactgtgcctcagttacatgttgggaccgtcagccagaaacttctatcgaggaaacttggagcgcattgaagttatagatcccagcaaaggttctcgtggccagggatgttgtctctgtaacacagcttggcttttaggacattcctcccctactaaaatctgagaggaaccaaggaaaagcagtgggttaagtttgggaaaatggactctctcattaaaggctgaaatcattatttctcctcactccttagtaaataatcttgagagatttccaaggatgttcaggagggagggtgggagagagaatggttcttgagcattcgggaattattttggcaataaagtaactaaagtacaagcataaaataactttagacagatgcagaattatttcagaggttctcttttgctctttctccagtacagtatttcctgccccttgctttgaaaagaagtctgaatgagagtggccttaacacatcactcaccctcacttgttaacacatcacttaccctcactttcctacaggaatgtcccctctttagagactctctggttatgtcacctccaccgaagggcagattcccctgtgtgccagtgtctttcaacatgatacctacctctttccttttggaattttgagaagggttgtcaaatgcagcattttgcaaaccatcatgaggaagagaagtaaaataagggatgggggcttagaagaggcaggtaggctttcccccctccgagagaggagagcctagagagaaaatatgaggttaaaaaaaaaaaactggaaaagcaggcttactggcaacttgccaaaccctaaaaaccacccccctcttttctgccaaaacaatactttagcaaacctaaaataattgcaggaagctcttttccattttaagaactattacctgggggagggaaaaaagggattcttaaaaggcacccttccagaggtgtcccagaaactgggacggtaatgatagcctatgtccagttctgggcacgcgtttgtggatcagaatatctcccttccctaaggggacatccctttcacatatttttttcctcctaaaaagtaaaagatgtcacagctaaaccactgttgtttctgaacgtgatagaactttttctatggcgtctgtgttcaaacccactagtttcacagtcctgggagggataacgctcattaatctccgccttcttttctccagacccccgccccccaaatccggtgaatcttctgtgggcactgattcctcaccacccccgcttctgaatgccacaggaccgaagctgcacaaagtttgcaggattgtgtgcataattacctctgccgacgaatctattcccacagaaagcttcgctggagagattacaatgctttgagccttaccgcatttcagtgggggaaaaaaagttacctaggaggtctgatttttcaaagaaatttgcatacatgcaaatgtgccgcccggcctcctcctcggttctctacgtgcccacgcggtggcccggggggtgcggggcaacctggcaaagttgcccaagtcctccaccgaggtccgcggaggtctgcagcgggggtggggggatggggacgaggaaaagtagttttgtttgcttaagcacatcctgtggcagcctatagctgcccgggagtacagactgtaactgctcctcactgcgttacccagtaatgcgctgatcgggggagggggcgggggggccggggagcgagcgggagagcgagcaagcgagcgagcaaggagcgagccacggagagagccggggagcgagcgagccagcctgcgagcgcgagcggccgcggaggctcgggacccggctggccgcgcggcgccgcagccgccccctcccccacaccccctcccccccgcggcggcggcgcgagcgggcggcggctgtgcggtgcggtgcagagcggaggcggaggcgggcgcgcgggcagctcgcgggcacccggccgggccggcgcgggagcgggaaagggtgcgctatgcctttaacacccgcgtacagtaggcatgtatagtggagtgtagggaaactctaggcggggttaaagttcagctcatggagcggcaatagcgctggctggctggctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggtaagccgcggcgtggatgcggagggcttgggggccggggcgccgggggcagggctggggctgggtggggggcaccggggccgtcgctccggccgggcccagggcgtgcgtctcggtgtgtgtctgtgtctgcgcgtgtttctgtgtgtgtgcgcgcgtgtgcccgcgggtggggggggggatcccgcttaaagaaagtaactttgtttccatgcgggtgcattcctcttgcacggccatttgtgtgggcacatggctaatggcgccctcttattaatgcgttaattaatatcggggcgacggactgcggaacagcagtgttttcggacaccccgcacgtgtttcggcggggttgcagtccatgacacgcagaaatctggctcagcgtttctgctgccgggagcagggattccgtagtgccgcagcgcccggggagggggccgccgacggagcccaccgctcaccccgcacgctcgggccggctgcagtcctcgggtgcggggagacctcgggtgcctgcgcccaacggcccgctccccgcagcctgcgctgccgcagccccccgccgtcttcccgaactcttacttttgtttattgtttgtcagccttcggggtccggccgcggaaaggacgcgggctcccgtcccggccccggcccggacagcgcccctcggacgcgggcaggctgcggctagccctcggctgagcggggctacgtggacgcgcgttcccccgcgccggccgggtggagcctgcgtcctcgccgcgcgccggtggcccgttggctctcccggagtgaaagtttcggggccgagacgagcccacgttgtgcagggcgccgaacgccggaggccgcgggccgcgggccgggtagcgccgggcagagttgggctcctagccgggagccggagcggcggcccgggccggacacggctccccccgccgccgccgccgccaccaccaccaccgccaccgcgcgactccggccgctccgcgcgcaggacgggggcaacttttcccctccgactcaactcagagcatggggctcttgcgccccaccgcctctcctttccgtgcccccctgtccattcctcccttgtctacccacccccaggcaaaatattgctacttcgagacttcaaatccggtcccctttgaatatgttatttgttttccttgactaaaaggcttgaagtcaaagtggttttgcgctattttttttttaagcgtgagatttcatactgctttggtacattaggatctgaccattaatcacctacatgaagttatatgcttcacataaaatgtttattcacctctcccttaaaaaacctaccacttcttgccttcatttagtaggagataacggtttaaccggaatagtttctggaaggctaaaaagtatcagtagttttcgctctcctctctagattctggatttatttcccacatgacatcccttcttattgcaatatctaacagtaataataccgggtatttgatctcagaagactcttaaacgcatcttttatgttgaaatggtctgtttgggatttaggcctagcattaataatggatagcagttacttttagttactgtaaaagttttttttttttttcctaacaaacttccaaagttcctattttagtaacttgtggaagtatggaatgaaacttttccaaccacttctggcaaggttcacaattgcatatggataagatgcaaagtgtaagataatttgaatgaattacggactatagtgaaaatgctgagattcgaaggctgaagttctagctggcagaagtttgcaacacacagaacttgtagataatatcagcgagctgcaataaagggaaaggaccctaacagatacattagtgtcttctcaattgagctctgaaaagataaatttatatttgggaatggtgcatatatgagggcacctgtatatccatgcaggcctagggcacagtcaggtatttaacaaagttggcctctgttggttcatgaggtattatgacattaagagagtttttttttttctttttttttcggcttacatattcagcagcgttgattgatgcattcactaggccttcttctggaaacaccactaagagaaatgcttatttagtgtaacagtttgtaaagaaaatgtacaataaatagtgaatgagggctcatattttatgggttctgcttttaaaaatttatttacaatttatttaacttgctgggatatttataatgttttagagccagttttaggaagaagaacttcggtagtttattgctcattaaaaaaaatcagtaagcacagtgatttctatcactatactctaaatgaaactccatttaacttgtaggcaatttaaaaaaaaactttaccaagaaaaacctagacatcttattttaatcaaatatgggcatataatcaaatcaggtactgtccatataatgataacccagcagaaatttgtaggtgaacttttaaaaaaagtagtttccagaaatatcagcattcagtggttcttaaacttggctcactttcaaacagatcaatgtttaagatgctgattcaaagtaataccacttttgaaacaggttttcaggtttgtttttattggtggcctataactttctcactgagtacatatgtaaaacgttctttttttcctcttgaatgttatgaaatagtacctagcttatagcgatatgttcagcaacatgaattataagggcacactactttttttttttaactaatcatttatgctattcctggacatttcttgcaagctaatgatactctttagttttgatattctggaatattttaaatcatgacttgagaaagatacattagaaaaaatcaatactttaattgtgcatatgagtaaagttatacaaaatattgtggacttttactggcaggttcttaacctttggggagtaatacattgtaaatacttttgatgcaaaattggggacttaagttattcttaatgactaattgacatagttgttcttgtttaaggatttttatgatgagatatatgggcatttggttggcaggtaaacagaatcctgttggacacgaatgcatgcatgcagtttgcagttttttgaaaagcatattgggagtatctacagacacttaaaatgccatattagaatgtttattttaaatgcttattatcattaatcaaacttttaaataagataacattttaacatagatatgaatcgtttggagctaagttatactttgcattataaaatggggatgaaactttaaaatgaagtcctccttttggtgaaagctcacttggtagtttaaggtagactccaggagttttttgcataatacaacagagtcttggtccctagcatgtcttgtatatataagaaaatcagtcaatgtgaagttctgtttcaaacctaaaatttatgtattttagatcatttcaaggatgagctcagaatttagtaacgtttagatgctttgtggtttggcgtatacctttgcagataaactgtgacttgccccccatgcctgtcacctaaagtatgagaataagaaatattctcaaacatcagaaattttaaaaatgttaatggtttatggcaagaataacaattcctgtatttttttctattctctctctacttaaagaatgcacacgtgttacaaaagctgactacttctcttttggattcttttattgaaaaagagcagttttgaaagctaaacttgaaacatagaacctgaaatttgtgcagagaggaaaaaagtcagttattgaagtaatttattatgtattaatatatacttacttttaaaagctcagtcatatagagtgtttaaatgattgattataatttgctaaatttttaaacaacacgactattaaatattttaccttatcagttcacatttgaacatttaaaaatttagtaattgtgttaataataatattctggacattactgctacctgtgccttgaaagtatatatttagttagatataacaaactgaaaaagaatgcattttataatatttgtctgtcctacaccatttagcaaaaaagccatcgaatctttctttggtttctaatcctcatttatttgaaggtaatctatgttttggagagggggttatgtggcagagagaagttatgtaacagtgtggattagttaatcaaaagttagacgtactccgaaagctttgtggaggttactgcttaattttttaaaaaatatatttatatttcctaagaaaatgtcatgtataaggatcaaacattttaagcaaaacagaaagaaacatttaaatatttgaaactcaatttttttttcaattttaagaggcatctatgagggttttcccggcatcttgtaaatattgaaaataccaggttctgattccctatgagaaaaatcctgaaatagtatttgcaaaaattaaataatctattttttaggtatgattattactgaaagcacttcacaatcatattagtaaattaaatgtattcatgtatgcttttctttgtttttttttcctctttcttccccctttttgtttcattcccatagtattagcaattatgtcttgggcatagatcttttattttagcctaataaatatcaaattcaatccttcttttgtatatgaacctcccaaatttgtcctagtttttgactaaaaaaattatatgtagttataatatttaaaaggggaatttagacactagcaaaatgagtaagaaacatatcagaatctacatgcaatatttttagggggaaagcctttgttttcattgattgtagagatgattttttgctcctagacttccataaacattgactggcatctaaatgtttaggatttgccaatctggcggctgggccctggctgtactacaagtggtgaggtcaaggctgggacaaaattagatatgccttccttgaaatagggttaagattatacattgttataagcatttagataaacttcacttactatctaaaggatggggagctaggcccgacagtagtagctggtgtaccctggtgaacatattaaaacagttttttaattttcagcagtttttttatttccgatcataagaaatgatactgatagttttctctcccaccttcccagacttcccataggatcctgtgtatgattttggtaacagaatgctctaatcaaatttcaagtgaaatgaggaatttctttcttaaggtgacccgctgaagaaaagttgttttcttttgttttcattctacttatatttttctttttgttcattttcctaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcaggtaagtgcgatggtgagaattcctcccactttcttgtgtgtgtttctttcctgatggcctccgcgttatgccggattcttcctgagctccccaagttgcaggccacgtacatgaagccagtgtggtttcaaagattgagagaggtgccaccttcattcaggtgaaaaagcatagctttgagcgaattctcactaagttcagctcttttggtaagtagtgttttcagaggcgttggtaatcagatatgtgatatgtttaaatcacattttttgatgaggggatgagagaagcctcgtgaaaacccttttaataaagagtatattttaactgacaaatgatctagtttaaaagcatttattttggtattgaggcaatatttttagttggttttctgctgggagtgtttttaacctactgaggcctcttgaaccccttgccaattaagaagttggaggtagattactatcaaattgctgatcatttaggaaggaaaaataatcacattaatacgcagacttagtagctttgtatttaggaattcttagtgttgtctcagatagctaagggaaacaaaccagctctttcagtaattgatggagaggttaatattaaaaataaccaacctgtatattgcatgaacacattgaaaaattgctattgataattgatgtagtgagttgctttgattgtaaaatcttaaattttttttctgttttttcaaggcatgtcttacctgtgcatgtttcagtgtttagaatagcatgcaggataaaactattgaggactggataaaataatgcatttttactttgttcctttcgtcttgttttagacaaaaggctcattgtgctatgtgaacgctcaggtcttgtgtaacttgttgactttatatatgtacatatcggtcttgctagattaccttcatggcagttacttgagccagatggaagaaagagggttgtggaatcctaccagtaggttgttttggggttcaaatatttaacgtttttttttctttttttttttttttttttacaaaggagagatgttacctgtaaaaacactgcacttttcttcaaaacatttttaattctaaaaatgttagtgagtttttaaagaagccagctgatagcctgttctctattatttttctcaatatatgttttagaaagagaacttttgttatccatctgcccttacataagaaactggagaaattagctttgcaagcatgtcacatcatcatttgcattctgttggcaggggatagatgagtattttagaggatgtgagctgtaagtgtttcaaatatttgggttttcaaaaatgtatacttaattataagaattgccttttgctttagccaattctgggtagcaagaatgaaaagtcagcacctctcaagtgacctctaagcaggaataagtagcccttttttaacccactcttaaccctgttgttgttcatttgttttgtttactgaaaaagtaaagttaaaatttttaaaaaatgtgtctgcatatgttaagcacagcaaaacgcaaaaaaagtataggtgttacaggtgctttcaagaagcactctttaaaatcttgtttttaccttttagatatttagaaaaatataacctataaattatcccgaatagatgaccaacatcgaaacttgaaagtgccaacaggtgatgcagatcatgatgtgtgcttccatataagataacatcaaaatgaaatacctgtgaagtttttgtcggtgtaagcagtgtccattctaagttttcgtcttaaacatttctctgttatttaaagaaatgcaatcttttcgctgttctcattacgtgccttctttttcgtcgttggtttgttactgtgctattgctcccaatccttgaactaacacagttgttggttgttgcaatgcctgaaggggttatgttggtaaaatgacatttagaaggttacttaggagagttagcatccttattgcttatgaaagatttattgacagcagcatagatcagactactcttcggtttggttttcctgatgtatcccagaatcccttgttatgcctgaatgccagccaaatgtttggccattggttttcacgggaccgcagtaatggctgcttctctgtgcgcgcaacaggaagactgtaaaagaaaatattaagggtcttttgtctgaaaatatttcaaatttgatttaagagattcagagacctgttatttgtggaagggaagctgccaatacaaatatgaggtagatcggtcaacttacatacaactgatttgacaagcatctgttataatactgaagatttgtaaacactaaacaatgtttttacctccttaaaagttttgagaacttgccagtattggcaggaggcagagactctgaaacgtgcttcaagatacatgccaaaaccattgtggccttttcacctataatgcgttttttctcgctctttcttttaaattgttatatttttttcctttccagaatgcctttttttccccctagatggtcatagaaattagatcttcttttccttctgaaatttgtgtgtaataattcttgctttatgtgtccacctttctttggtaggaagttgaaatctcagaacatacgtgagaatactagaagcaaatgcagaatcaatctttttttttttaaagcggaggtgatttattctaagacttattgacatgctaaaatataatacataaactacattccagttttttccctctaaatccagtggcattagaactgtgaattttgtggctgataagcagtaacaagtgtaatgaaattggagtgatttcataagcctgagaatttcatcttgttaaaagaacaaaaccattttatgcccttaatttggtctcaatttgagttgtccttcccatgtatcatatgacaacttggggatactatggtattgtggcaaatggttttctttgtgggtgtgtaacagtaaagctaatttatgaccagtctttaccagatgatctgtatcagaatctacaatatacccggcacgtggcaaggtcacaatttaagttgttaaggtcataaccttagccaccaggcatttgaccttttagataaagttaacctttgttcattagtaggcactcaaccgagaagtttctggagagttgttgtttttttttttttaaccacttctgtataaacttctggtaatgtaatcagattctagaaagattctcagtcaaattagttagattttgtgaaaggttatactttttaaggactcatttcttggatagaggcaggttgctatttttaggccatagaatgacagtttcacaatttatatttgatattattacctgccatggggtagaataaaagcttggaggcagctgtgtggggacatttaaaatctaaaattaaacaaattaatttatgtttaattcaactaaggcctttgctaattttcaagtgacattaggcctaaaagctaaatcacagtgagccatcttcactttttgcagatgaggaattttctaacattagaagtatttttagcagtcttaaaattcagtttgaaagattaataagtgaccacaatttgtcaggtaattgctttaattgttaattagccagtgacaaagcaagttgctgttgtcctaatggcagcagtatgagtacttgttagttttaaggtagaaagagaacacttttgcacggtaatcttttagtgcagtagttactgattgcttccatgctgctaccattattacctttacttaattttgcttgcatcaggaatagcaaagatcctttcaatcactgaaggagctgtttcagtgtctcggaagcctgatacctgtcctataaacctactcaacagtattactgattaccacattacctgtaccatattgttcacttaattatgctgacatgaatgctcatttcaaattatttagattcttgctagttttgttctgctgtacctcatattattccatttcagccaaaagagagctactcccattcaggtgcattttagttttattttggcttcgtgattgccattccttcatatagtaatagagaaagccgtgatatgcagatagaccagatggtcatgttgacagattgagaattcacttcctactgcttcagagcaggtgtaagattaggagtgtctgtgtaggggcgtgtgtgtgcttcgtgtgcatgtgcgtgcacatccaggctgcacagagtgctgtttgagcaatgggaatgatttcttttttgaaatgctagtattttaaatacagtgtaattatacagataaggttttcagtgcatatagaatattataatttttataaataaatcgcattagattgttacagtttataattttatgccaaattaattatgaaaattattttaatttttaggtaacttcctacattagtttgaggcaacattgcatatccaaaatatattcaatatattcttttagcagctacatgtatgtgtgtttacattcaaatctaggactatacgtttttgtaattaaactttttcagtaacttaataaacaccctagtagaaagttgtgcagttacttcctgtgatttgtaattattaataaagtgtgtttggaaaaagaatatacactgtatattgtatacacaatatacacaatatacactgtatattgtaaaactaatatacagtgatatttaaattaggagagtaaggatcaccctatcaaactctagctttaagctcaaggtggattttttggctgatcaagctattgtaaattattgatatatggcatatttttagaaattttaatttatcttttaattcttcaaaaaagatagcagtagcagtcaacaaatttgagataaatattgattttacatccttgagtgttttctgtgtaacttgaggatagtaacaatatcctttacctagaatgtagtaacaaaatcctttatctggaatgtagtgcaaaagatggtagttctaaggcagagagtgtacaggaatagggagaaatagttgttctggagtaaacctttgaatggaagtcagttcatttatggctaagaggttgagtgtgttggtaagaaaatttcccaatgcttctggcttggattttccttgtcttcttttccaccctgtgatgaatagcattaatttaaacctatttaaggctagtgtgggagaaaccacagcctttgttgtggtcactgctgtacacagtaggactgggtgtttcatttggttaaggcctcaagctgcttccagaggacacgggacagcctgtcggcattttaaatcttgcacagaagcagcaacaattctaattgctcacaaatgtcaatatagatttttgaaaccaattttgaggattagactagaagaaaaaacataaaatgcagattgagttcagtgaatgtgctaaacactgatttattaccattttagtaataattttcccatggttatttaagggttagagcttgcttttgaattattataaattgtaaacccatgggggttgagtaagggaaggaagaagtcaggtggaggaggaagagaatgaatgaactcgtatgctttgttaaagagaaacataaaaccctgaacttaatcacaaatggagataccgtaaaagtattttggtttcagtaatgactgtaaagcagtcttgggcagtgagctatcaagtggagaattttataatttgtcttcccacaattttttgcatagcttttttcagactaagacactatttagagctttgggagtttttattcaagtttttaggaaaaggttttgcaaaaattctttttagaatttaggagtccagttagagacatcattgcacacttaagctcagaaaaggggccatggagatgtttattctttttactattttgctttctaaggtggcagttcagagtattgtcaaatttttggctctttcccagtaggcaacggtaagatactcattattgatccaaacttttgggtccctgaacttaacagaattatttagttgctgcttagacagaaatgacttttttccttagattttccccaaaatattagaaaacaattcctcatgttttgttttaactccacagcgtaaagcatattttatctaatggaattagtcctcccgttagtgttctagctaaataaacatggcttatgaagtgaagaaataagtccaacaaatgacaagttgcagcaactctgaagcagaagatatttttgcttttctgtttgtaaaacaagctaaataagataaaactgagaaaaagaagttcatttgtattgtgtattttggcaaatcttggtcttctttaaaatgttgctaaccctaaaacaagaaatgatgaggataattatgataactagagattgaagtggaataactgtaatgttctttgagaactttaaacttacttcttttcatgtctttcaaatacttccctagtggtagatattttggacctagatcaattgggagtagagaaaaggagatggaaggaaggaaaggaaataacttttattgaatgtctgttctgcagcaggcactgagtaaggtttgtcatagtcatatattgtagcttgctgtcgctttcatagcagtattatgaattagtaatgcactctctatttgaacggatgaggatagactcttcagagtggccaggttacatgtccagagcaagattcaaacccaggtcttctgatttcaaatcttatgctcttaaacaattcaaattcattttgtatccttctttatatcttattgtttagggttggatgtcgttttcatggtatcacacacctgtcttgaatcaaagggaaagtaaaaagtcaaaatccaaacccctcccattgagatatttcactgtcaaattcagatgttagccacagaatgaggccacacttgataaagagagaaatgatgttacacttgtcactgttagggtcaaaatctgaaatgatttgttcttttttgtttttataatgttgaaatttagtgaatagaagcattatgacacaggtttaagatttttagttgttgttaagacaaagttaaactaattcgttctagatgctttgagaagcctttgtgtattaaactaagcactattttaaaaactaaattgcatgtaatttttactatgcagatttttgtacatggttttatatgtacaagacataatatatatttctaatttcccctatacattacatatatttttatatatatatttacagacagagaaatatatatctatttctaacttcccctaatgattggattttaaaatgtaaaattcactttgctctgaaaaaatcctttggttatggctgtgtgtgtaattatttaaaataaagccaaaatcatgtttgagaaaagaatggaattttattagtttaaaattaaaaaattaaaataggaaaaaaattgaagatggacatgtttcaatttcgtgcccttaaattagtgaattagtgagcttttttttgttgttgttgttgtttgagacggagtttagcccttgttttctaggctggagtgcagtggcatgatctcggctcaccgcaatctctgcctccctggttcaagcgattctcctgtctcagcctcccgaatagctgtgattacaggcatgcacccccatgcatgtaatttttagtagagacagggtttctccatgttggtcaggctggtctcgaactcctggcctcaggtgttccacctgcctcggcctgccaaagtgctgggattacaggcatgagccaccacgcctggccatgagctttgtttctaactctttaaacttagtcaagattagttctttttttttttttttttttttttgagacggagtcttgctctgtcacccaggctggagtgcaatggcatgatcttggctcactgcaacctctgcctcctgggttcaaacaattctcctgcctcagtctcctgagtagctgggattacaggctcccaccaccacgccaggctaatttttgtattttgagtggagatggggtttcaccatcttggtgaggctggactcgaactcctgactttgtgatctgcccacctcggcctctcaaaatgctgggattacaggcgtgagccaccgcgcctggcgacaagattagttcttaatgatttcagtgcaaaaactcaaagcctcactcaacataatttttataattgtaaatagaaaaagatgaccaataagtataatttatactatattaagtcattatacatattaattcttctaaggtttaatttaaaaataagcagctgaactgaacttacagcaaagaaaataaaatagctttctttttaagaaatattaatgaatcttaaagttagggttgtgtagcatcagttatgctagaaagggaaaactgagtttgaggcatgtgaagaaaagtgattaaattggttaaaaaaatagtactcatatcctattgtcaactgtatctagttccatactgtatgtatttttatatctctggtaagtgcttatggtggtcccaaataacttgtgagtttccagacatagacagttctcagagcatgtgtattcatataaatttttaaatggctattgctgtagtgctctacaggttaaaaaaagtgaggcgaaattgaaacatttaaaaaatactgtactatttaaaaatttgtatgaatgtctgtgtagcagctgccattttcaggctgtctttgttgctatggtttggttgattttatttccttttgtaattttgccagccagtgattgggtagtacattgcattcatgctgttggggaagatatatctgtggtgagtcagatagcttgatctgagtagtaatttttagtagggaaaggtatttgtcagtgggtaatagaaactgtagtgttacattacccatcttcatttaattttcaaatttacagacatgtcacttaatatcagaaattcagaaccatctcttttgcagtgatatgtacttgcctctctccttttgtcctgtcagatgcacttagaattctgtgtagtttaatcttaaagggattagttatttaattttaagctcctacataaaatgaatattgtacatacagggtcccatcattgtcactttcaaatattccattgcctttcaaaggagctgacatgacaagtccttaggttgacaaattctcatcaacttttatgaaaatgttggctgcagaaggagtaaagtcaaaggagggccatagacagatggctttcagtgttgagatgacatcaagcccttcttcgtggcattttttaacattccaaatgaatgagggatggagatgcttaaagagcttactatagaataagtaattaagatattgtgtatctgcatgtaaacccctgttgcatactattaaacagagttgtgcaggctcagatataatagcagattaacaatgacaattgtaaatatcttttatgctgaatgtaactcataaataatattacacattaacatgttgctgatggaaaactgtgtacctgagaacatattttcaacattagataattgagaactaacgataagtgggttaccagtgtttgaaatgaagcaaagattctagataagaacttggcaaaagcttatttgcataagaaattttgcgtctttatatgactatgacaagatttttttggatggatgcacaccatataaaaattactaagttactaaagtttctgatggattcatttagttggctttcctccccctcttcttttaaatggtagaggttctcttttggagagtagtttcaagtaacttctgagaatgaagtctttgtaacgatgctgttcaacagcgtaactattgttgtgcattcctgtcagggaaagatagtcattgcagtacttttattgtatggcctcttaatatgtgacaaggacttttattaagaattcttttcttaacatacttttagaagtctctccttttcccacattcaatcagtaactacagttttaaaaaaatatttaaatgaacttttattgatttcttagcttactgtatagacaaaaatcttacgtttaaaaaaggttttaaaattaatgtattttagagtttcagtaaaatgaagtgggaacaaaaattaacaaaaaagtgccatctcattggatccaggatatgtagtaatacacacacacagttctatgtctgtgtaaccatatatatatatgtatacacagttctttggagaatgaggatatttcagtccaaaatgttatggttgaagaactaattgttctaaagatatttgcccctggccccagaaaagacgacaaacatgcaaaatggataaatgtaatcctttgtacttttaccacctacatttttaaactacagtaactctgatttctctagaaaggtcagaggtttcagacagaaagctttgtaattcttcaaagaaagacattttcagtttggctgtataaagactgattatgcatagctttttactttatgtgcggttgaatcttggaggtgctggagtggggtggggacgatgaataagtgaagctgtgttttgagacattagaattggagggaaacagacagattggagaggaacatagattcatatttttgggctttttactatcaagtcacccagtctaaaactcaggacagagcagcattaaccattcattttgctttgtgatagagcattcgattaccaactctttaaactcttttggcaattcaaggaggttgcctatctgggtaccatttcttaggatttgctttgttggattttctaaattgtggatgtgagtttctttggttttgcattttttaaaaaaattttttggtcctttttaacttttccaagttttggagaatttttcatgttgggcggtgttggagaagtagagattgtagatgaccttcgttgtggcttactcctgttatttgggaaatagacgttcagagagcatctcacttgaggccacaccaacagttaagaggcaaagccagcatttaagccaactcccttagatcccagacttttgccctaaaactatattatttaaattatcttttcttatgtgtttttaaattagcccttcatataaacttcaaattttaggtaggggagcttttatggttccctttatgccagtgaggaaacagccagagaggttgagtaacttgtccagggttatatggttaataagtggttaggattagtaactaggccagacccttctatggcctgtttttatctctaagatgatccccagtatgttagacttgaaactatggatggagtgaaaaatattctctgcaaatacatcaacactctgaaagccattgttttctctgtttagaaagtagttgaaaaagtagtgagaaactagagctttttcttttctggtgttagtttcagcttcctaccttgaagggaaccttaaggcccaaaccttcttttttacatttgaggattctaagtccatgcatctcggaaactatggagacgggaacttcttgtgtgagttggagagcagttgtagaccgttatcatttccatcggtgcggatgctctttgggtggtggtggcatagaagatctgttttggttacctttattgacaagctctactgtgtgactggcagttcagttcagcagataggtttccagcactaatcttaggcactgtgatagattcccgagatgcaaaactgaagaaaataccttgagacaagtcagtgccatctcagatataatttcctcagaaatcaagattttagagcatttgatgtttttaaattagagtcctttcaactaatagcctgtatgaagtttttaaaacacttataaaaaatttatggtgattattattattttgagacagggtcttgctctgttgcctagctggagtgcagtggtgcagtcgtagctcactgctgcctcaaacttctgggcccacacaatcctcctacttcagcctcctaagtagctgggactaaaggtgaatcccaacaccctgggctaacttaaaaaaatattttgtggagatagagtctcactacattgcccaggctggtcactgaactcccagcttccagtgatcctcccacctcagcctctcaaagttctgagattctaagtatgagctgccaaacctggcctatatgaagttttaaacatttgtagaaccagttgttaacattgctttttttttttttaccataaaattggtatatgtcgaggaattctatcgtttgactatatttctattgtgttaaattttttgttttcttatatcaaaaatatttttgtaaatgtaaagaaaattcaagcagacagaagatggtgcaggtgctttctattatttaatagttcacctggccaggcacagtggctcatgcctgtaatcccggcactttgggaggctgaggcaggcacatcacctgaggtcgggagttcgagatcagcctgacaaatatggagaaactccgtctctactgaaaatacaaaattagccgggtgtggtggtgcatgcctgcgatcccagctactcgggaggccgaggcaggagaatcgcttgaacccgggaggcaaaggttgtagtgagctgagatcgcgccattgcactccagcctgggcaacaagagtgaaactccatctcaaaaaaaaaaaaaaaaaaagtagttcgccaccatagcatgttttctctaaagaaagctggttgtgcacagaaaagttctattttttttaaagggcatccttctagtaatgctgaaatataaaacaaatagcgttataggaaaatgaaacagcaggagaacgagagagtagaaaacagaaaggaagcgaaggccttggagagcaggcggtagtgaattcatttggcagttcctaaaacacagccaagtcccagtagcatagccacctaaattccctattttgctccttcttggaaaaaagttagcagtctcgagacttttacgctgaagtggattttaagttgtcagaagtgtcaagctgatttgcctttttttctctcttttattaaaagaaaagagatacatactacattcagacagaaagcatgtaaggggtcttataagtgtgagcatgtgttagtggattaatgggacaatgtgtgtggatggtgatagaaaatatgagagaactattgcttggctgataaatgaaataacaacaagaaaaatctggtggcccaatatatattggatttgttgttattctctgttatatctgctggttgttcaatctgaaagtgaaatctgtttctccattcattaatacgtgtgcttttctttgtatagagcacagaacaaattatttgttccataattatttttaaaaagcagaaaatgtgtttgtaacatttaagaaatggcatgggattgtcatagaaactcattctgaacactgtaaataaaaatggttggggattagtcacagtaacatgtaggacatcatgaaattcaagacagatttctttgtctaacagtcagtaagagacatgaagcgaacttgatatagttcatgagatattagcagttcagttccttcagagaaagagaaaaccatgttgcttcatattaaataagccatctgtatacaaatctcacaatttacttgatgattttagcaatatttgatgtttcctttcagagtcttatttccaaataatgaaagcttaaaaaatttgaaaatctctctgtttttgctactaaatctttagaaccatatccctccttttcttctttccctatcttattttttggtaatcttgaatagcattttaaaagttttagctttattctgtttcctttagttttcccttacttcatataatatgaataaaactgaacacattaatgataaatagccttcaataatactatatatttttaaatatttcaggttagaattatgagtctgcagtattaccattaacatctttttctgtttttcttttaatccagtatttagaaggaaattgtttcagggtactttttttctccaactctgtccaacatctggaagaacgattgcctgtctttaaatttggaattaatctccaattgcatactcctgctaggctgatgtttcagtaaattctaacgcatcagcctcagatctttgattccttgagcttttggaagtagaagttaaagtctgagagggtgtttcaagacttaggaaacttagtgctgtggaatgacctgtgcatctgacaaggcccctttaacaatgttgtgtgtcactgcatgttcttatttgtaatcaaaacagtaggtacaatatttcaataagggtaagtgtatttagacaaatgtagcctgataaaagtggataaattaccttttgtggttgagttaattagtgaacacaacgaaccttgaaactggtgggagcatgtgcaaagacatatgtgaaaatgttggtacatggaacatatggaaccatcttgtcttcctgcctgtgtacacaggttctattgtagtacaggtatatgcacgcatatttttgttttattccttgtagtagtcctacttgggatgtcctcacccacctttacttggctaacattatttatactttaaggctcagctgtaacatcatttcctcaaggaagctttcttttccccccaaggttaggctaaggactgcttccctgcctgcccacagcatccattagcagcatattagtacttgccattagcacttcctttatcataataaaactatttgtctacatctgtatttccagattgggctgtgatttctttctgagcagggactgggttgtattcagtgtttttgtacccccacataggggtgcatagaacctggcacttaactgtgcactcagtatctttgtttagctggtgactagatgagaaatctggattgaacaaaacaagaacttgagaagcttataatatggatcttaaaactaggtaacatataaaatagtttttgggcatttaccttaggactgaatttaagcctatgttttttacagaatgattttcctttctcaccctaccatgtcaatggatttctatttcttcacccaaatccatagtttcatattaacccaaaggaattattgacatgtaagtaattataattctgaaaacaaaggtctgatgatgctagacaattgatgatgctaaaccatttaggctatctgtttttccctttaagatcctggtcttgacttttatttgagctttttatctagaaaagatgatttggtgatgatggagtaatatagtaactgctctagcttatatgtgagggtataatctttataccaataataatttatcaagtgcctactatgtgctgggtaccctgctaggggaggaaataaaggatttcaatttaatgctattgcatttttaaagagcacaattttgattaaaaattgacccattctcttcagagtggacactcacattttttgtgggttttgaatcacatagtgtcttgctgtgcaggaaaagggcctgtcagtcatgtctttatttctcttgagcatttgtacgttgtatgtctgtcctcacttatcagggtgtttttggcatggttacttaatcctaagctctgagaggcacaggaagtaaaagaaaagttaaagatgacaattaaggtgttgggcccagttagatatagtgaagtcagaattttccctcattaaaactgttagaccaatttcattagacggaaatgcacccacatatgtaaatcttctttgtttaattggagacctattgattgtaggtaacataagcctctctaagggaaacagaacccaactgaagataagagtttcttccccccaacacatacagcattcatgattttatttctctaggcgtgttcattatcaaaatcattctactgcagactttcccataaagtgtttctgtctggccctgttttcatatctaaaagcttctagtggtttcagcaagaaatgatggaaacattttgacagaatatatatttctttttttaaaactaagatcttaaaattaaagagaaacaaaaacttacaaaatcacatgaaaatataatgctttaaagagactgagaataattgtcttcttttgtgctttcatagaatgctaaaagaaaccaaattctgatcttctttggtgagcaatcaccaaaaatattgcagtggggaatgaaaaatagaatggatttttaaaaaaacttacattctaattaggtctcaatgctgcagagaaaatagtgtaccagtgcaaactctacactgtggtataaggcacaggattttcccgctgcgcttccaaggatagggtcatcctattataactgtttaataataggggattgtgtgtattttcttatatatcttcttgcaattccatgtttctgaagtgtgagattcaggtcaaggtcaatgtgtggccagttgtttataaagtattaagaatctcatgaaggagaaatacagtttagatgtagattttcttacgataactcaaattatgtttaaatgacaaaaactaggtaggtattgaggaggtaaatatctctatttttcatttcttaacattacactacaatatgtgtaatatttagaatttgaattaggaagaactttaacttttttattccttagggtattactgatctctaaacaagatgtttaattagcagaattatagcatcttagataaaattggttatttttaacttaatcacgtagttgatgctacagaaatgaattcatggcctttcttgtggtgctcgtctttttcttgtttgatgttgctagttgaacacatctcaggttgtgagaagtgcatatttagatgggaacatcttggagagatcttgattggtagagagtaactttatatcagtgagtataatgcttatcagtgaaattctaactcatttaattattacttaattttctgattatgtttttgtatttgagagaagattatttccattatggcaaagtatggatggatggacattgctattgccatttcttgacttagcacacctaggaaggcattttgaaacatactttttaaaaaaagaattgcatatctgtgcacctacaacagtgggtgtgctgaaattctgacttgggttttgatgaaagaattccccaattcagttaaattcatccttgactgtcgtgtgccactcatgttcacttggttaaaaaaaaattgttttttggagattatttgtagaatctcggttctgtaaccagatattgaatattaccactggagggaagctttgaactcatttatcacccttctgccaaaccacaaaaatcctctctctctctctcatgcatctatctatctatctatctatctatctatctatatcttactgatttattcatatatatatttcttcatatatatgatatatgacactgtatatttacagcatatatattacagcacagctatttacagcaacctggatcattcattcttagccccttctcaagaatggaagtttattttaaaccagacataaacaggacataaaatgaaatattaaaagactggataatgcattttaagtcagacatacatttggatagctgttgtttgagtttgtccatgctggagttacctcctcctcactgcaccctccctgtttgcatggggagctgagattagattttaactacaaattattcacattagtcaaataaaaaagaatgacatttcccccaaatttgattattattgtattttcttggagaaaaagatcgtgttagtaaaataattcaaaatggaaatccaaatgtatttcttttaaaatttttcaaatctgttgctaaaaagctgtagaatatcgtggaaaattcttttattgtaacaaacattcctggtttaatttcttattttcactttatttttaatataaatatatatgtaacttataacacatagtatgaactgaaaatctgtgaaccaagaaagataacaaccaatacctttcatttacctgtgtgttcttttcctctcccattaccctgaaattcctcctattatcctgaattttgtgtttgtaattcccctcctataaaataaatggtttatcactcataggtactaaatatattgttcagttttgcttgtttttttaagttttataaaaaatcatatatacacacatacatatacatacatatatatatataaatacatatacacacacacttctgggaattgctttttttcactctacaatatgttcataatgtcatatatactgtaatttattattgtttcttgtgtaatattctgtgatggatctatagaaggtttccagtttcttggtcttagcaagtgctatgaactgtaacatgtcttctagagcaagtgtgtaaaagtttctttatggtatgtgcctaggacttaaattgttgaattacagggtgtgtaaatgttaagtttttttttttaagaaaagatagtgatattttatcttactaacaagttatgcctgtttatacgatcactcgctgtagcagtatacaaaaaattctgttgatctgcattctctccagaatttggcactgccagatttttctttttgccaatcttgaggctaaaaaagagtatttcattgtgtttttaatttgcatttataatttgattactaatgagactaaacatctttttgtatatgtatgagccactttactgtggaataaatgtttttgtcatttattcatttttttctattttattgcttattgtttacttattggtttgtaggagttctttatagattctgcattctaatttttggccagtgtacgtttgccaatatattttcgtagtttctggcttgttttaaaattttcttcatgttatctttgatcaacaaaaattcttaattttaatacagtaaaatttatcaatctttatcacatggttattgcttttttgtcttgttgaagatatccttttttactccaagtttagaagtatatggtattttttgtatatcttttaagtgttcatctcacattaggtttgtattccatccggaatttgtgtatggtgtgaggtagggatccaatttcattttattctgtatgaatggacagttttcactttatcacttattgaataatttctctattccccaaataatgtaaaatgatacctctgtcatttattttttatatttgtgtatgtctgtttttggattctttgctctgttacactgatcaacttgtctgccctataccatcaccacaatttttcacttactaagcccttataatgagtcttgataaagcaaaatttcacacctctttttgaaataaattttttagttattctttacccctcactattccatatatatcatggcattactttgtcaagttttgtgaaacatcctattgggactttgtttagaaatatattgaatctacagataaaggaaattgacatctttttttaactatcaaatattattatctatgaacatggtatgtctcttcatttatttagatcttattcttggttacactgaattttatttttcaccaggttttgaacacttttgtgaagctgcttttgtaaattgtttttaatattttgtttttaactctaatttctagtatagaaatacagttactttgtgtatagtgatcttatattcagcgatatttacatatttttagccaataatgtattggtaagttcttttttgtttactatttcgataatcatatcaaatgcaaacagtgagaaagatgttcatttctattctatgcttttatcttccttacccttctcattgcactgagatctgcaactcagtgttaaattaacctgtgatagtgggcattcttgatttttttttcttgatttcctatttatttttaatccctgaatgaatcagagttaatgccttaatatttaaatattactttcgctgctcacattttaatcagagaaaggacaagacctgacctagttttgttaattttcctcttatttttaaaaattttatggtttggtatatgctaccataattgaaacctcagattctcctcacaaattactttatgccaagtggtatagtatctgttaattagtgggtaaatagtgtttttaaagaatgcagtcatctaaaatttcaaaatataaggctcatttgtatgaattaattattttaggtatttcagggaaaagaattaccatatttcatactgatgagattttttgatactgtgttgtgtggctcagtctcttacgttttgatttgaactatagaacccttaagtagcattctgttttttacaatttaaaatgtctggtttgcatgggtttactttttcctttttcctcatgtaatttttgttaagacttgaatagattactcttctaatcttgtgagcagactgcaggaagacaactattaagagtagaaagctattaagcagtcaggggtttattatgctttagtgttttgtttaagtctgttcttaattggttgattaatgtacgagaagtccttttcccccctccatctctacagatggcaaatggtaggtcccaactgtcattgttcacaaaaaaggttatggttcaaagtcaaagattcagagataccacaataatcaatcataggaacttgtctcagagtgcccagccaggcaaaagttaggcagagtaataatatttactgagaatctcttatgagtatttttttttggtgtgttctttattttatttagaaaatattatttaattaattgaaatgcctctgaatttagtgacaagcatttaaataaatatgaaaaataatggtcaaaaagttttctgtttatcggttttatcagatagtgctagaatacataattttaaaatgggtgtaacacagaaaataacattcttaatatattgagattaacagaacattttcaaaggaatacctttttaccattttcatgtgaagattatttataatagttaacttccttttttaggaggaagagtagaattatgttctggtattgatccacaaagaggatttgcattttattcatactataaaagtacctttaatggagaccttgtggtaattgaatctatactgtgtatcactatcaaagtatctttttaattattttatgttatacaatttaagtcatggaaagggggatgactgtattgtatcttttaagtataatgtatagcctttaatattcttaaagtggatgttagttaaggacaatttttagttgagagagagtgaaagagagagagataaggggggcagagaggattccattacattcagcacagtatgaaactaagtcaaaggagttttgttaattaaattcaattgccatccattagaccagtggaatgagatgactctgcctggtgctgacacagcacaggtatgcaatttggctaaatggccatttccaaaccatagcacacatttgtctacttgttcacttttttttttttttacatgagagtttttactcttagaaaagtcaaagagtaacccagtgcttgtcgaggggtaaaggtatcatttttatgcagcatattgtgaagtgattaattttttaggtgaaaaatatatagttcacatagagattatttgggagaaaatgattttttaaaaaatatgcagtatctgcgggcaagcatacgaacaaatatatatacacacacacgtatcagtatagaaaaatgtgtacttttaaaattcagttgtcttaatctgaagctatttgagtcatattctctggattttttaaagcatcctacaatctgtatatataattaggggaagttgtaataattgcaggagttataaaagcgaaatttaggtggtgggtaagtgtatctacattttggcataaatcactacttttagaggatttatatgtcagactgataagtttcttaccatggtgaaatgacaagaataccactcaggcattggctgagacataattttgacagccagcaagcttgcagtgttgctgagtgcacagatttccacttcctgccaagattaaaattggcaaaaaccaaaaaggatattagggattgtcactttaagaagaaataacatgttaatgttctgcatttgcttaagaaatgtaagagtgatctcttgaactgtagtctgttgaaacttacaagtttgcaatcaatagaagagtttgattaatatgagcatcaaaaattaaaataagtagaggctctctgacacttgttagaattaagactcattataggtttacttaataggacataattactttccttctatataagatgaattcttcacaaaagctatgaaatagttttcctcacagtccctgaagaacaaaggcctactttaagtttgtagatttgaagactgaatgcttgctttacttcctgaattttcttattttttcctgtgtgagcagatggtttttctttttataagttgccagatctttcctataacaataactgccattattgagaacctactgtgcgcttattctgtactgagcactcagatcttcagagttttttcttacttaggactttttgtttaactctaggtgtaaaaatgaagaaaaaattatatctcatgttgtgaaagagtcagactctgaaatctgcttatactttgctatttacagtaagtacttttgaaacagctgtagacgttcaaatgaaagtagcaatgtggagtggggaatgtgggaacattcatttgtgaagactttgcatttcttcagctttatagccaacagaaaaggagattgttgtgcattctattaaatactgccagtatgattaatttaaagggttacattttattgaaccctggtgtagatgttctttgtcaacccacattcacagctagttagagtgtgtgtagcatttatcaaaactttctggagcccctctcacctcattagcatctgaatctctattcagcagttaatgtccgttactgctagagtgctcaattcttgttttcaataagccagttgtaaaatgtcagactgtcacttacaatataaaaaaccaaaaatgatggtatttgtaaaaatgttatcacctcataaaaacaaattgtaaagacatgaaagtgatcttgctatgctggtctttcagaagtgagttagtacagctactttaaataccagttgtgtagattcccacacttttctaccaatggagaggtttacacaagcataatttaagttacaattacactaattaacatctcatttgcataaattgttgaagtcaaaacaacaaagaattgtctaagaagcttaatcctatttgtccaaaatagaaagattttttttttttaaaaaaaaactatgctctaaaaattggcagcttaagtatgtctttagtatgttgagctgtgtccttttaaaaataaatgttttcaattttcttaataatatatttctctattctttttagaatccttcatttttagtatacttttaaaattgaacacacacaacactttggttcctaaagtaatgataacaagaaattaaaatcaaggtacagtatcatttatatgtagtagtacagagtaaccatgacttactaggtgttatgatgaaggtgtatgtgtgtgtatatgtgtgcatgcatgtagataagtgtgtgcatttgcacacataagagttttaagctgctcctgtcatttattgatggtcaaaggtttcttttggctattgctggactcttaagattgtcttgtaattgtctttttgttgttgttgaaaattaagggtgtatattaaaggtagtttttacccagatcttatatgtgtgatagctcacatctgtaatcagaaacttactgtttaatggccacccaattgccattagcttcctagagggtgatttaataaactatcttctttaaaactcatttaaaattagagacatgtttgcatacaatggattaatgacgttttcatactaacccacaaaagtctgctgcactttcttttgtaggcctaacattcatttcatatgcattgattattattgttgaacttgcattaattacatcgtgcatatatggacatacaatgtcatctgcagaatttaggattttttattgttaatttttatagtgactgtggattgaggaattaaaattagcatgcttcatttataatagtatttctagtgtttcattagccctaaaaatgtgataagatcaggaataagattggaatgaaaatttctccttaaaatggtacgtcttttgaaaacattttgtttataatatatagctaatcctaatttattacagtctttcaatatattctttaatttgattctataaggcttataaatcactgtctttgagataagtttcttaattcacaggtttgtatcagttgtactaggtttggtgaaggatgtcatcctagatatacagtgtagacgtgctttatgaaacatacttcttcttagggacatttttaaataccaaatgagaatatgtttggtgggccaggtgcaggggatcacacctggaatcccagcactttgggtggccaaggcaggtggattgcctgaggtcaggagtttgagaccagcctggccaacatggcaaaacccagtctcttctaaaaatacaaaaaaattactaggcatggtggcaggcacctgtaatcccagctactctggaggctgaggcaggagaattgcttgaaccgttgaggcggaggttgtaatgagctgagagtgcaccattgcactccagcctgggcaacaagagtgaaactccatctcagaaaaaaaaaaaaaaaaaaaagagaatatgtttggtagaaatctgaaagagaatttatgctgaattgagaccatttggaaggcttcttgggtaaaactgatttgagttgtggatgaaggattgtttggaaatgagagaatgagcagaggccatggtggagagaagagttggagagcaggtgaaaggcgtgagcacagctgcagaagcagacatatgcacgatttgtcctagagcaggtcggttggcgagtttggttagaatggggggtttacatagcggagggtattgaatgccaatttaaagatctaggcagtaagaatcatgtagggtttttgaacagggatatgacatgcttcaagaggttttttttgaaaggattaatcatgaagtccaaatgtagggagcattgaaaacaagagtagagtgacagacagtggaacagtagctttgtctcggcacaaaattataaatcatgatggtttttatttcctgtgccctgagtaatatcataaacaaaatatacaaaatggcaagagcacttttgagataatacatggtttctgattctgagtagtacttgaaacttcaaaaataacattatacgataaaacacatgttatttctttgttatcttaaaatagcaacaaattctatatacgtagaaagacctatgtagaaaaaaaatgaacattctagcctggacaacatagcaagaccccatcttaaaaaaattttttttttttagtcagccaggtgtggtggcctttgcctgtagtcccagctactcaggagactgaggtgggaggatcacttgagcagggagattgaggcttcagtgagcctcagttgtaccactgcactccagcctgggcaacagagcaagatcctttctcaaaacataaagcaaaaaacattatttcctttctcctttcagaggaaaattatttccagattattttttcttatatttttttaaaagttggctttaagggagcacgtttctctttgagggtggcctgtttcattgtcaatatttgctcttcattggaagctgaggtcatgtcagagttactcaggagaaagacctggacttttcttcttatcttttaatggtttatcattgataagtttggacatggtatgcatggtgacttttttcactcttgtcacttttctatatttaccttgttcatagtatgtaatctgagtgccttcaagacactagaaaagatttgatctcaaacaccacattttgggtattttaatataatcaggagaaaagtggatataatattcagacaggaagctggaatacactggcataggtagaagtattcatttcaacattaagtgaatatatatatatttgttgttgtttgttttgttttgtttttgtttattttggttagaatctcactctgtcacccaggctggagtgcagtggtgcgatcttggcccactgcaacctacacctcccgggttcaaactattctctttgctcagcttcctgagtagctgggattacaggcaaaggccaccacgcccagctaactttttgtatttttagcagagacggggtttcaccatgttggccaggctgatcttgaattcctgacctcaggtgatccacccacttcagcctcccaaagtcctgggattacaggtgtgagctactgcacccagccgcaaatatatattgataacttactggaagtaaggtaacatggtacaggttggtagaagaaatatagagaaaaacaggaagctgggcttcccttccagatgtccctagattcaaaggggaagaggcaaaatgtattaaatgctgtcttacacatagactacaagggatttacttggccagggagagaacagggttgattctgagctggagagaatgaggatggcttctgtgaaggagatgacctaaagcagggcctcgaaggttggcaagggacttgcagggacagagcatggagatgggcatatgtagcgtgtgttctggacacggcacgtggaggcagagcacacatgcatagagtgtgtaatgcttcacttccatccttgttccttcagcaagcacccgtgctttacctcgtgctgacccttgagcaaggctgcccgtgagaaacttcccaacttcatgggcaatgttgaaaacatttgtccacttgcccttgccccagagagggagaaggtccacatatggtgcctttgacatgttatcccttggcataaagtttggcccaaatgtacatttgaaacctcacgttccctcgataaatttaaagtatgaaacttttgaaactctaaaaaggtggtgaagaccacagttctccctgttctttttcttctttcactctgcagctggattctgcctttcctccagtggttatctgaggagtgtctgccatgtcttctgtttttttttttttttgccttgttttgaggagtccccttttttcctcccctgggagagtttaaatatgatgctgatttcttgtcatcttagggctcctcagctacaacaaagttaaatggtataaaagcaaagcccaaattagagaccctaaaataaccttggagaaggagagttctcagttatcagtagaattgtcttaggaatttgaggaagcccttgtatacagtgaaaatgagaccctaagttaattaacaaaatgaaaataacttacagtacatatctgccacttccagtactgctataaataattgcaagtgtaaggatttttagtgcaaatatgcagaaaacatgggcatagaaagtttagatgaccttaatgaagaaacagagttggctctgaaactgtgcttagcaggaacaacgttttgtgcacttgataaacactgtcagttgttaaggcatcttctgataggtgaaaagcggttttttgatgcagtactgcctggcatgcatcttctcgatggtctgttatcttgtgggaatgacattcgttaagttgttttctgtgtgcatcccacccaaataaagaatgtttcatcagcaaagtgaattgccgtatagtcatcagactctagaaataaattatcaacgatgactgcagtgggtgaggctgtttgtttatcacatcacttgagaacagagtaaagtgagtttcatattttcctgagtcttgaattctcattttagacatctgttcagaagctttctaagccatggagtattctaaatgagcattttgttaaatggatgaaggaagacttagttttccattgttaggtgaaacctaattaaaaattaaataatgaccttgtgttggcttgtaaattccttatttcctgcatgtgtgagtgtattttgttagaacattccattttaaagcatgccttttttatgacaagaaatacttttaaaatactatttgcttttgaaattacagtagggaatcaaaggatagtctcttgttgagaggaaggtattagaagcatgtagctttatgaactatattttctgtgaatatagcagaattagtttaattgttcaatttcaccctctccagcatgattgcacccatcagggcagttaacagagacaccgctatttgtgttatactaggaattctttataaacttaataaatgaaagctttttctcttataggcccgattctctagtggacttctggtgaaattatgtggctaccttccattaatgttaatggaggttatggatataaatccctccatagtgatggaagaatgagccccagagagaagaatgtttctaatgaatcactggattgtgatataggattaacttggtgtccctaataccatttttttttcctcctgaaagtttaaggtcttatgtttaggaactagtttctctccaccttaatcctttattgtcaagtctgcaataatgttaagaacaggaaaaaaaaatgtagattcctggataggcacagtttttatattaatgtaactatataggcatagtttttatattaatgtaactatacagcacctatttttgtgttttactattacttggcagacatcttgagtgttttacaaggttatcgtatatttcactaataatcgttgcttgataatttggtgtcctgacagactgcagtttattatttagtattaaagctctcaaatgtatttattgagcacctgctgggtacaaggctttgagcttagtgatgaaagcatatgacatagtctgtagcctcaaattttctataatctcgtgataaaagtaggtaccagttcattagttgctttccagtggggcacaaattatggaacatcgtctggctggccgggcgtggtggctcaagcctgtaatcccagcactttgggaggctgaggcaggtggattgcctgagatcaggagtccaagaccagcctggccaacatggtgaaaccccatctctactaaaaatacaaaaaatgagccaggcatggtggcaggcgcctgtgatcccagctactcaggaggttgagacaggagaatcacttgaacctgggaggtggaggttgcagtgagctgaggccgcaccactgcactccagcctgggcaacagagtgagactctgtctcaaagaacaaaaaaaaaaaaaagaaaagaaaaaaaagaaatattgtctggctaaagaaaggaaaagaattcttattcagaatcagcatgatcacttctgggaatctgaatggagaaaataattctatatgtaatgatgttttcaatcaatattattttaggtggtttatttattcagccaactgttgttggctgcccactgtataccaggcagtgtgctagatactgggagtacagcagtgagcagcacagagacagccctggtctcatggagtgtgcactttgagtgtgggaaacagtatgtgggtacataaacaaaataatttctaatgtgatagatctctaaaggaaacaggcaaggtgatagagaataactaagaggacctgctttagatgggaatgtgaaggatgaggccgcattcatactaagcatccaagtaaggagaagaccaagtgcaaaaagtttggtcgggatgagtgtgtgtgtgtgtgtgtgtgtgtgtgtgtgtgtgtgtgtgtgtgtgtgtaccagagactgaaggccattatggctggacagttaagggagagtgacctaaataaagttcatattggcgggagagcagcttgccacagggttacacagaataggcagtggtggtaaaggcagcatttgaatccaggtccatttggctttggaatgtgctgttatagcagcagagggcaagtgtgaaacataattcaaggaaataattgctgtagccatccagaccagaggaggatcgctttgatctaggaaaacatctcagtagtctttgaaaaaatgtacagaatatgaaagatattataggtcttttcctcctataatacaaccaggaaattattcaggctaattttttcagaaaaattattacaataaattatgatctccctttgaaaggtataatgtattcaaacctttttaattagctaatcttttcctgtgaaatcttaaatatttgcacgtataattggtaattttagcttttatgtaggtatgtttccccctggtgttacttacaaaacctggcttactcaaggcccaaagtccaccccactagtaaactctctcgtctctgttcctgtgccaagtgctcttcctttgttaccaggtccacataattaatagctttatcatatgaggtaattcagttactcagcaaaacaaatgatatacacttttagaaatagctctagaaagtaaacttgaacgtaaaattgtttagtaagaggaaatttctgtttgtctttaattaagagaaactgtatggaaatgtaagctaaggatgcattaatcagagaagttggcattgcactgttcttcatttttatttggcatagattgcatgggtgctcattaaataatttgtatgactgaaataacttgtgatagttcttgctaaagttttgcatggactcagactaaagaaactttaaaatttgaattaaaaaacattcaattcttaggtttgaaggtttgagttacttattataactgaaaatctttattatcaaaatgtgtgttcattatagtgtttgcttgccttcttgggtgaagaaatacttattatgagagtatgtagattttccgtgaagaattagtaatcatgcatcaggttgatacctggtgagtagatatttgtatttaatgctcttaaattttaacagccttgcctctgtatgccctgctcatctgtgtcttaccaactttgatattgtttgaaaaataaacatttgaaggaagaagtttgcatatttagagggttggtagttcattacctgcatgtaggttatgcccacatcgcaaagaaatctgatctatatgggtaacatatttggataatcaaggccaaggtaaagggattcattcccccttcttgaattttatggtttctgtatgtcaaaccagatttcattggtttaaatcttgtggtgtacacttggccattgatttggtttgagctctgtaatatttgtaattatgtgagatgacaagattgaattaacttaattgtagagttttacatagtgtctgtatcaacatcctaataaaataatatgaaattcaataagtaatgccaagtgggacagtgagccactcacataagcttactaaacttgatatattcttatggcactcctccagaatgtagaagaaacacatttatctaggtgattagtattctttctgtctgccagatttaaggattgtttggaaatattgttagaatcaaaatcaacgtttgttactacacagggttgagcattccaggcacactctggtcgttttgttattctaatgtccacttatttcatgtctgccgtgaccgtgacagttttcagtcacacagagctgccatcaaaagagtgataagcttgtaagtgaagcctttggggaagcaataaagtcatttttctggtcccatctcaaaagacattattggaaatttatttaaaagtgatcaaggtagcacatacgaggccttctacagtttgcattttggaagttattaacaatctgcagttaagtccatttaaaactgaaagtggctcttccacaaactactttttaaatagcttgctggttctaaatttaaggagaatggaaatattggaaattaaaagtcaaaagaaatttctggggcataagatcctttcaagtttacaatttctcactttagatttaaaacttgaacacggccatactttgcattttatgatatctaattagtgccttgtaatatattttgtgaacagtatctgttagccataatatcagggacagtttaaaaaatcttcagtacatttatgataaaagtattagcattgtaaggtcttaaattgacatctaggacattaggaaatcaaatttaaagcattgcattgtctgttactcaatggagtggactgaggacagcgtgtgacttgtgtactgcaaatgatgcaatagctaaatatcctagtgtgagttaaggttgattaagtgatcatctttaactctgcttttcccagggctctttgaactcttgttttattaggtaatatgctatgctgttattttattgctgtttaaaaaaccttctcttttgggaaagaaaacatgtgaattctttggtttctagatagaaattagcaatcttttgctcggaatgtaaaagtatgctgtattatcacaaactgaccctcctcctccccaagaattctagggagtaaaatgcgtgcacaggaaatcagaaatggatcaacagagttataggttttaaaaaaactgccttgcatttttgccctggaattaattttcagtgaaaattaaaatattttttctgttcatctggaatcagtttttacttcattagcaggaaatggtaaatatacattcagcacaaatagagttttctttatgggacacaggatttgtactccataggtagatgtgtaacataaaagaatctttctgctctccttgtaattttctccctcttaccctcaataagttaaaagaaaggaaaattttttaacctaacctgttaggaaccattttagtgtagcctctagtattttgataaaacaaaatgttcactagctggaccctggtggtgatagcatgaaggactggggtagaactctctttttcattttcttttaatcctgaagttacatcactgtgcagtcagctcaacttgtgtcattgcagtaggaagatatgtaggtggaaagctattccagaaggaggctggagctaccttccctgacaagaaaaaaaatccaagcaaatacatacataaaaagacactcaaagcatcataggatgttatagttataagggaccataggtttcatttaacgcacattttagcatccaggtcctacataaaatgtatattttgtgattgtgaatgggagttttccatatttaaaagttaagtttattaatgtgtcattttacccatcatgtatttgtggccatttttttaataccacgaatgggaacatactgtatcatagtttctttttatttgtctggatgcttgtgtatgccttttagtctactaatatgctcacatgtgcaaactaacaagagaagatggcaatccggtattataaactggtaaagagttatagtgcagtaagactggattaactgtgctttcagcagtcaagttgctgtaagagttatattgtaaagttttagactaacttgcatgtatcccagagtttgcacggtgttgctgagtgtctcgttagacatacaccctacctactattctctcctgacataaaaaaaggtggtaattgagctggcatctagaaagtggtggtagcactacagattgtatcactaatcccaaacaaaggagttgcaaaacacctttctttaaatattttctcttcatggtgcaactggggagggccaaattccagccttaataaagttttaacctgaccagttggtagaaatggcagagtaatagaatgtttggtccagaaaccaatgtgtggactgtgtctaggattagactctgcatttctgtctgttccagatgagctgctcatttcttttctttttttaatttaaatttttaagttctggagtacgtgtgaaggatgtgcaggtttgtttcataggtaaatgtgtgccatggtggtttgctgcacctgtcagccatcttctaggttttaagcccagcatgcatttgctatttttcctaatgctctcccccacccagcccaagctcttcatttctactcagtacgtatgtccatgtatccaggagaaatggagagttctacttttggattcttctagagagattccctgtgggacttctaacccctaatcagtattcttccgttgatgataatctacttaaatgatatcctatcatcagaatccctttatggaattatctttgtattttgcacgttcttccattctagcttctaaatgtaatttttcctcccttaaatcatttttctaatggagacaacattcaaatacataggacagagcccacagccagggcgggaaacctgcatagtgaggctggttttgatacgcaggccatcctactggcagctgttttgtaggcagcttcatgtaatagtgcagagggtacagagagagagacctacactgtgatttctttcgtttgtatattttgtattgaaattgtagattttttggttggaatttatttgagatgattcaagacattttgcatagtactcaaatataggtgaaagaatttcaagtttgctcattttggcataattctaaaacaaaagtgttactgttggatctgggcatgtgatgggtgaatgagtgtttcagtgaaatgacataagtctgtataatttggagggtaatgatgccttagaacaagaataaatctggagcgatggaaaggctccatattctagatgaatgcatgcttcctcttatgactctgaaaaataaaattaaatctttatttatacaaatccagtgaggggggaaggctacatggtttggcttaatgatatatttcagaacaggaatattagccttaacctctttcctcacattgcatatgatatttaatccatcatctttgttttaaacaaacaatacacaagctgttgctggcattggtataaagctgatggtccatctggagagcaggaatatagatcaggaaaataagagaattgaaattgggtgcaagggcagatttgcatgtgtaaaaacctttctgttttaccagcttttatcaaattatttaatactgggcaaaacagattcctttttcttgaagctgagaaagatacctcctcctagaggaagagttgcttcagtgttctaggaagaacaattggttttgaaagacaataaaataatgagccattaggatcatgttttgtaatatagggagttggtgtggaagaggagagagaggactgctggtgtagtgagttcttgttctagctgtgtatgatcattggccagtcgttcagcttcttggccttcagtgcttcctttgactcaagtcaattcagcaaccatttattgaggcaaatgtgaggatgttctgtgggctacctatttagctaggcattgtggatccatagacaagtatgactgggtcctatgcttatgaaactccaggtcttacaatggaaacatactgtggttgaacgatgtagagagtgttgtatatgagatatgggtgcacaaaaacaggaaaagtcaattctgtctggtgtagacaggaagaattgtattacaaatccttcttaaggattttctattttgacatgcaagaggagcaggcattccaggtatttgaatactgagagattcaaattatcagcaaggttctttccagttccacgtttgttgtgttatcagtgtaaaattatttgaatagctttccactgatgagttattagctgaaaagtgtttattgtcatggttgaaagaaaataataatgaaagaagaaacgattacctttagtgataaagttggggccggatgggacgaagcagtgcaatttttttctttataattattcccctatttgaaaaatcaacttgtatatgaggcagcaaacaccttgcagagcagcattcccttttagtttcaggacgtggtggtggatggaaccactgtaacctggcctccctccatgagaggagggaatccaggtggccatgttgaaatgtgcctgtgtgcagcaaggcttctgaaatgacaagagagcccagcagcttccaaagcagctgtgactctggatctcacccatcatctctgcttctcactgttagaggagtgaatctgtgctgccttaggaggcatggaacctgggacttttcttccttgtttaatgtttaattttattaaaataatttgtaagtgatagatgttgatctcgtgacaaaagagagattccctctttataaaactattctaactaaagatcttttgtaagcccatgtgttagaaataaaacttgaatatccccttttttgttgttgtttatgaatggccaataatttattcacatgtgacatttgagctggcattttttcctcctgagatgacagtagcgtccgctgtgttgtattctaaagcaaagtcagaatagccctttgcttttgtcccgattagtagttctgttttgccttcttgccttttccatttagaccttatggtatttcctaaaccttagactgttttgaaaggctttgattaaaatatgctgataaaagaattcgataaccaagttaggaacgacaaggctatctggagaagaccaaatgacttggcagcctaacaaattctattcagagcacacaaagagatcctggaacgttttatagggactcgtgtgtggggaatggtatgaactcaggttacctgcaaaatatggtgtcatatggaaacatttaagagcttatggaaaattctttgaaataaagtggaatgagctagcaagcatattatacctaagaagaaaaacaagagcattcattctggttttttaaggtagctgctcaaggaagggagatagatgaaagtaaattgttttctactttgtacacataatatagaagagatcacctaagcctagttttgctaaccagaccctagacttaaaattagaggtcatgatgtctagccaccttcctctgtaggaacctctcgtgataccctgaaagcctctgcttaaatacttccagagaaaagtgaggaaggtaggggtggggatgaaggtttgcaggaactcgtgttgagtacctagtatctgcaagatactagagtaggtactttatcgccatctcatctgacttatgtatgagtgcaggttttataaccctcaagtttacaagtgaggaaactaagtttatataagtgtcacgaaacttgcttcagttcagatgtctagcttgaggcaaatctgaaattagaacctaggtccatcttcttgcattacactaaactgcctctcaggatgagggagagctcccttcatggctaaggcaacctcttctgtctaataatgcagattctttaaaaattctttcttttatttaactgaaatctgcctcccattaacatctctcattggtcctgattcggcctcaggaggatcacagagctgatgcaattctctttccttatgcaggtatgtttgcaaccactgctgccaaaatggcctctgccatcttttacctagttggttttttttgaaaatgaacacacacacacacacacacacacacacacacacacactcacagaaatatcctcttattgactgcaatccatctttcaacatatggagttctttttgaatactagaggtatagccttaaagaatatgagtatcagaagatactttagtttcatctttccctgcctgattcatcagccaattgttagtatgccatcagtcaagccattaataaaaataatgaacaaggtgaacaggataggttaacttgtagtctatgtataagtttctgaagttgcatgcagaatttagcctatatgtgaatttttctggaaaaatggtcagtaactattgtcagattccttttttttttttttttttttttttgaagacaaagtcttgctctcttgcccaggctggagtgcagtggtgtgatcttggctcactgcaacctccacctcccaggttcaagtgattatcgtgcctcagcctcctgagtagctgggactacagatgtgtaccaccacgtccgactgtccgactagtttttgtatttttagtagagatggggtttcgccatgatggccaggctggtctcctcctgacctcaggcagtctgcctgcctcggcttcccaaagcgctgagattaaaatagaatcgcttgaacccaggaggtggaggttgcagtgagccaagctcgtgccactgcactccagcctgggtgacagaacaaaactcccatctcaaaaaaaaaaaaaaatgccaggtagagcagctcacgcctgtaatcccagcactttgggaggccaaggtggatggatcgcgaggtcaggagatcgagaccatcctggctaacactgtgaaaccccatctctactaaaaatacaaaaaattagccgggcatggtggcgcacacccatagccccagctacttggaaggctgaggcaggagaattgcttgaacccgggaggtggaggttgcagtgagctgagatcgcatcgtgtcactgcactccagcctgggtgacagggcaagattccatattaaaaaaaaaaaaagtattgagaagtactcagagtagagaacttactcccgaatgaatatactaacctctttgaggagagctccccaaatgaccataaattcatatagctcagccatcactagaccgtgtatttcagccagaagatatggtgaatggtcttgtaagatgcctgactaaattaaagtattaaagtatttcttgaattctcttgatattcctggactttgagaaagaataattatgcccttaaaaatggaaaaagagactgcaatattgttatacaggccttttaaaaaaaaagtatccttaaatttttagttacagagttcacttttttcccctacttttctttgttttagattataagcccaggattgttcaccagaaggttaccctttagtctgcaggaacctttgaaaacagatgtggtattgaagaatatctctgtaagcccagaacttatccattgtataaagaattttattttccccagtagaccgggagctcctcaagggcagggacctttgcaagtctttgactccctagcactgaacccagcatctggcaaatcttatttcatgtgactttattttggctgaatggcctaaaaatgcgcttgtactgagcacctaatacatttaatttaatttttaaatttttattcaataatgtagacgtggagtccccctatgttgcccacgctggctcaaactcctggcctcaaggatgttcctgcctcagtctcccaaagtgctgggattacaggcatgagccactgcaccaagccctaatacatttaataaattgtaaggaggaagaacagtggaccgcagtgagatatggtctacagggaaaatgaagaacctcttcaaaaatgatgatcttcaggcctgtaatcccagaactttgggagccgaggcgggtggatcacttgagcccaggagttcaagaccagcctaggaaacatagcgaaaccacatctctaccgaaaaatacaaaaattagccatgcttgtagtcctagctattaatacgtgggaggctgaggtgggaagatggtttgagtccgggaggtggaggttacagtgagccactgtaccccaacctgggtgacagagtgagaccccatctcaaaaccaaaaaagatgacctttattatgtttgacatttaaaaaaatgtagccaaagtaaaagtgttgattagcataaccccgatcacatgttgttgttgaaaatgagcactggcttgcataaaatggacattcatggacatgaaatggacattaatgattttacatatgttaagaagagaattttagacttgagaccttagggagatctgttgatagaattccctatgctctacagataaggatacttagtgaagggactttcctaagctcacagacccagaagagtagtactctttccagccaatggtgatgcttacttatgtttttttttttttttttttttttttgagacggagtcttgctctgtcgcccaggctggagtgcagtgacacgatctcggctcactgcaagctccgcctcccagattcacgccattctcctgcctcagcctcctgagtagctgggactacagacgcccaccaccacgcccggctaattttttgtatttttagtagagacggggtttcaccgtgttagccaggatggtcttgatctcctgacctcgtgatccgttcgcctcggcctcccagagtgctgggattacaggtgtgagccaccgcgcccggcctacttatgtgttttagaaaaatctttaaaatgttaaaagatgacaggtaatttctagaccatatgaagtagcccagttgtcccaggattagtttattatgtgtatatcagccattattttacagagtcatctcacataaatccacacaaccttaaaggattaaaggatggtttctgtgcaactgaaacatatgcacagaatgacaatagtcgtgatactttctttattctttttttttttttttttgagatggagtctcactctgtcgccctggctggagtgcagtggtgtgatctcggctcactgcagcctccatctcccagattcaagcgattctcatgcctcagcctcccgagtagctgggattataggtgcacgccacccgcctgggtaatttttgtatttttagtagagatggggtttcagcatgttggccaggctgatcttggaactcctgacctcaagtgatccgcccacctcagcctcccaaagtgctgagattacaggtgtgagccaccacgcctggccagtcatgctactttataatctgaagttaccagttctttgcagtgtttcacattaggggcattctccaaagggaactttagagataacaaatatgttaaaaatatcgaataaagttagagatgtggggagacattcctactcctacagagagcaaccataccttcctatagactgtgcactgaagaaagggcggaggggatgcgcctgttagagttagaatcttggcttgataggcaaggaaattgacccggtgtggtggttcttatattggtaagaagacccttctttggtttctttttttccagatagctaaagtcaatgtcagtgattgcttcaagcatgatagtcttaccagcctacactctaagcttttcttatgcttccagaatgacttactcagcaatcacttctactttgtattaaaacagttttggttattcaggtaggaagaagagaaaaaaaccaggctgtttccagttgtctggggtttacattatgttacctctcagactgttagtgaaatcagggagactagtggtttttacggcatcagagataccaaatgtacaacagacagatgtcatcttactctttttaagtcatggacaaaaagacagacacattgccctgtaactttcagatcttctgtaacctttttaaacaacataggagagaagttggtacttgtacccaagggaagagaaagttaatgagtagaaaagacagaatttatttaggaaaacgatggaattaagctctggacaaaacatgcatcagtgatgcataacatttttgttaattgggtcttaacaggtttctgactcatatggtaatcattgtagaagtgggtcttactagaccacgccagtggcaaattgcgaagctgtaagaactcttacctccctgtgtgtgtgcacctgagtgtgtgggggggcgtacgtttctgtagcttaatttaggttccacatacacttcagtggttaaacctgagctagactcaaatagtttgtttccattaagaaaatgaatcttttatgtggaccaaggtcaggttagttaatttgtttgcttttattggaataacttttcccattccaattcatcacttaattttaagtggttctactaaaatacccattaaagtcctttacatttctcacagactagggctatgacagattcataagacgtttcttttttcctcaaggcacaaaaggtagcttttctggtcatcaatctagtcttccttgttcctaatttcacaacagtggggcaacattttatataataccaatatgaactctaattgcaaagagactaaatgaaatcttcacacgaagcaagattaattaaaatataaaatgtgcttgactgtggtaaaacatttcttttaaaaaaaatagtatgacttttttttttttttttgctaaatctttcttttttgtacacctcaccctcttcttcactgatgcattttccagcaactggaagttcactctggctaggaaagtaactaaatgtgatgttatcattctaattagtgattacaaaagatcaattaatgttataattaaaaacagtgtctagatctgttgtttgtagtgaataaatgtgacaattactttgttcattgacatagatgtgttgaatttcctccctagattttaaggggatgcattttagtgctgatgtgtgcatttaactgtggacagtaggaacaaggcaagcatattaggggaagagtagggcccctaatgtctaagctacagacatattttagcatgcttgacacctttccttggtatatgatgctatatcagcaacttgtactcattggatctggagcctctagcttttaatattttatcactaaatgcttaagtgtttatgttgcaaaaagaaaaggaaaaaaaaaagattcccacttggactctcaaaccatgtgaacaggctactctatgataactatgtcattaatgattttggtttcatttatggcaataatttttaagttgatcagtcaggatagtaagtatgtgatttttgcagatctggttgaatttttttctgatacagaccaagctgtttttcatacattgaagcctgggaaagctctgttactgttaaaagagtaaccatatctcttcactgaattgttgccaagcagatgtagacttttggagtgtgcccagaaaacctctacagctgatactttggtgacttgttcctactcctggctttactggcacctatttaaatagcagaggaacataattgtgttttggtaggtcaaaattttatacacttctgtagaaaaaattatatataggtaagccaattggtagaaatgaagtaaacccaatttgcttgttgagattagcactgaagatatgctaagctttggttatgtcatttggtcaaaaaagaatgaggaaaatccctcagaaaagttatctgagagatcagcactgaacgtcaagccagcctgtccactcccattactaaaagaaatctccccttttaacttcatcccataaatggatcatgcttcctggatccacccgaggaggacgtggtttagttttagattcttagattacagacttccaccatcagtttcagtattcttttcacgatattaatgttatgaaaactgttagaaatgaggaaataccgccatgtcaggttcactcatggatcaagaaatgagcattttcttaaacatcagtccaaaacaacaaacctcaagtaccataagttcagataacttgggagcagttgaaatcctttaagccacaaagatagtgtcttttggcatggctggtgaaagaaggaagctggttgaattcattgactaactctgttgctggctaaaaagacaattaaggagaaaagggatggaagaagaaaagaaccaaagaaactaaaatctgtttctttttcaggaggagttggaagatgaggagtaacacaacactttagatatacatgttaaaaacttataacaaatcatagatcatactaaaggattaccgaagtttagaacatggctgagggtatagatgtcagattttcttacacaatagtgggtcttttgtttcagagttcactcttggcaagcaactccctaccactgcgttaatttcctgtcgatctttcattcagcaacagacctagagatggggagcagacactgccccccccacccaggctttttaagactgtgctttgtgtagattaaaaagacgaaggaaaaaagaataaactttttccaaacaagatgtccatgtgcattctttaagatcctgtgtgtgcttaaaacgatcctgtaaaaaagccctctccataattttgaacctctcctttttctaaagacttttataggcatttttttttcttcttctcagcatgtgaaccaatgtgtaactcaaatagatgttactttgctgtttacttagattgttttaaaaggctagctgtgtggaggaatgaggaaggaagggaggcgggagtggctggagtttttttttttctctgttgacctaatgaatgcagttcttaaaaaataataaatatttatatgtggtcttaatttttaatgagtctcataaactggctggtatagaaaagtgtatgaaaagccatatatattaaactatagttattataaatacatgcatatgtacactagaatgttttatgaggaagggaacttactagtcttgttcactctttgttttcccagtgtctagaacagtgcctgacatacaactggtactcagtaaatatttgttgagtgaacaaaatgaatgtaaattgacagcattgcctagtgggggtaccattagactagaattcagaaaacttggagtctggttccatcactgccattaatcaagaatatattgttgctgaaatcacataacttctttgctcctctgttttttataaaaaactgggactagcccagctattcaggagtctgtggtggaaggatgacttgagcccaggagtttgaggctgtagtgggctacgattgtgcctgtgaatagccactgcactccagcctgggcaacatagtgagaccctgtctcttaaaggaataataggggctgggtgcggtggctcacacctgtaatcctagcactttgggaggctgagggggtggatccagaccagcctggccaacatggtgaaaccccatctctctaactaaaaatacaaaaattagccgggcgtggtggtgcatgcctgtaatcccagctactcaggaggctgaggcaggagaatcgcttgaatccaggaggcagaggttacagtgagcactccagcctgggtgacggtgcaagactctgtctcaaaaacaaaaaacaaaaagaggaataatagtatctgctctccttgccttttgtgggtttttttgatgattaaatgatatctgagggatacaaaaatgctttggaaactacagggtgctttacagactgtgtgtgtgagtgtgtgtgtgtgtgtgtgtgtgtgtgtgtgtgtgtgtgtgtacagaaaatcctttatctctttgcttctcaatttcttttcttaggaaaatcagattatttaaatcccattatgcacagctctcctctgttcttactaagcctctgtattccattacctccagtaaatcagtaaaaggtggtgagtcaggctgtagtggaaagcggggtctgctgttttctcatgtccatgttactctgtgggactcagaaatcttgcttacatgtctcatgaactttcttacctgtttgaactatacaggctataacatatgacttagagtcttttagttatgaccactcttaagattgatgactaagttgaagtatttattagttgttattatggtggattgataatcatgcattttaacatagtaaactaaagtctgtgtcgtagaattagctataatttactttttaggctggatgaggttactgatgcttgtaatcccagcacatcgaaaggctgaggtgggaggattgtttgagtccaggagttcaagacaggcctgggcaacatagggagaccctgtctctattatcataaataaaaacaaatttttttaaacaagtgtatatatgcatatgcttatgtgttgtaataataatatgtcccagagttgcacatctggaagagaagaagatagcaactgaaaagaaaatagaatggtattgacaaagagaaaagatggcgtcattaggacaattactttttatttttggaacaactcgaggctttacacccattcttttcccacatttattttttctatcagaattcttaaatctaagaaacaaataatatggaggttctttatattaacacattgctttaaattaggaagaaaactgtgtataggctgcagcagactttaaaagcattgtaagactttagatttggaaatcaactttaataacatggaaactttagatttaagagatcatttaatacagctactttgatttggcttttaagagaactgaggcccaggtagcccagaccaaggatcttttgcaaggtcgtgctactgggttctttagcgtcaagactgtaacctacatctttaggttcctaaatttttatcatgccttcttgttacctaactgttgattgttgaactttcttttttcttttttgagacagggtcttgctctgttgcacaggctggagtgcagtggcgcagtcatggctcactgcagcctgaaacttgagctcaagcaatcctcccatgtcagcctctcaagtagctgggactactggcatgtgccatcacacctggataatttttaaaaattatttgtagacacagggtctccctgtgttgtgtgggctggtctcaaactactgggctcaagctgtcctcctgcctcagcctcacaaagtgctgggatttgaattttcttaaacctaaatcaatattataggcctcaccttaggagaactttccaaaatattgttagtgttgaccaccttagcattacatttgctaacgacagtcatccaggtttactgaaccaggaaaccaactttcaggttaataagacagtttcgtctatgtgccatccttatccttgtctggacatatccatagagcacgcattttaaatctgaaagaatatatgtagtctcccctaccccagctttttttaagtagcaagggctattgaaaaaaatcagaaccctccgcttacgctcgcatacatgtagcttaaaatatatgttgcttattgaaagcattgtttaagttgaactcacgagatatactacatcatgtaatatgtctgcatttgtccatgcattcttttcggaaacctgatcttacttatgtctgcatttaacagataggctaggttaagttatgttaaaacatgttgtactgaggttggattcaccgtgtcacagcctggctttcttccttgattagctttaatcaaactctctgcattccgtgaccttaataaagctatttttcctgacaactgaagactgtcttaacaagcatagttcatctgtgctgaaactaaggctgagttaagatggggtttaggtcctcattaaagtccacagcatggagtgtaagaagaaatgatgaaatggtgctccctgaaacatctcttctttaaatttaattagacaaattatacgcaaactagtagatgccctgggaaggcaatcaacattagggctaataaaaagcttgagtagtataaaaaggctgggggaggtgctgtggagcctttctaacgcctatgagaggcaaattaaaaccaattgcgaaacatggaaactggatgaatttcaatattgatttagaaattaattttattatgttgttctaaatataaaaataaaggctatacttattaatcttccagaatttgacatgttaacacctatgcacaaagcattttatggatctttatatgctgggagacacaattatgggctgacttggaagttttggcagacctgggttcaaattctagcaacttcccctactagtttttttgtttgggggggttttttcggtgcacattacttcacctttgtgaaatccaatttcatcatctataaaatgagataaataattctattcctgaagaggctttataagaattttagaaaattaaaatagtaagtatagaacacttggtacaatgcctggcacataataggtgttcagaaataggtaccccatatttagaaggaacttccactgagttaagagtggtttcaagcaaactgtcctataaatatgtgagaattggattatgaatgtaaatattgtgtgcgtaatcttatggatcaagataagtttaagggaaaatgctagcggacagaaacttatagcttttggaagaaaaggtgactcaaacataagaagcaaattatttgaagcccacagtagccaaatggagagagtaggttgaaacatttgttaagtgctgcatgccaaacatcctgtataccttaccatctcatttaatattgataacaactccacaaggtagttattactgacctaattttgcagataaggaaaaaagagattcagaaaggctacgtgaattgcattttagcatagaagagtcaggactggaactcagtgttggcctagttcttgggggtggttggatggcaaactagtgcaggtatgttcataacttgtaagatcaaatttgtcatataaattacggggatatgtaatctctctcccttctggctcttttcatccttgggtgagttctaaataaaactattttgtgttatttttttaaccctcattccattgctttcagactctggttctcaaccttggctgcccatttagaatcacctggagtgggatctgggcgttagcattttttaaagctcctctagtgattccaggtaggcaacctgcactaaagacctctgctttaaaatctctctacctcaggcgtaggtgttttcattgcccatagtattaagcctagcttttagcagagatttgccaaggttgattatgatcctcttgcttgtttggaagaagaaatatggaagctgtgaaatcttttccagttgtgatagatgttgtttatgcattaattagcatgtaaaaattaaacactgtctattcttaatgttagcacattttctttctctctctctctctctcccacctctttttttttttttctattgaaggaggccaaattagatggagtgaagagaaaagtgattatggtaacttttcccttcagagaagtcaagagcaagagtatttttttccaatttcttagtaaaacaaaaaatattttctttccttttttcttttttgtttttgagacatggtctttctctgtcacccatgctggagtacattggtgagataatggctcgctgcagccttgacctcccaggctcaattgatcctcccacctcagcctcctaggtagctgggactacaggcacacgccaccacgtagggctaatttttgtattttttgtaaagatagggtctcaccatgttgcccaggctggttgcaaaccaccagactcaagtgatgctcctgccttagcttcccaaagtattggaattacaggcatgagccactgctctggccaaagttattttcaaaatacagtggttttaccccaccacccttagaggtagaaagaatctttgaccccaccacccttagaggtagaaagaatctttgttgccggacagatttgtggtaaatcctggtttctcactttctgataaagaattagtcattttatttgtttgtttgtttatttatttatttatttatttatttattattgagacaagatcttactctgtttcccaggctggagtgcggtggtacaatctcagctcactgcaacctccgcttcctgggttccagaaatctccctcctcagcctcccaagtagctgggattacaggcatgtgctactgcactcagactaattttttgtatctttagtagagacatggtttcaccatgttggccatgctggtctcgaactcctggcctcaagtcgtccgcccacctcggcctcccaaagtgctactattacgggtgtgagccaccgtgcctggctagaattagtcattttaaattcactggggctgggcgcagtggctcatgcctgtaaccccagcactttgggaggccgaggtaggcagatcacttgaagccaggagatcgagaccagcctggccaacatggtgaaacctcatctctgctaaaaatacaaaaattaactgggtgcctgtaatcccagctacttgggagactgaagcacaagaactgcttgaacccgggaggcggaggttgcagtgagctaagatcacgtcactgcactccagcctgggcaacagagcaagactgtctcaaacaaaacaaaagaacaaaactctctgggcttgatttcttaatctgtaaaacagaaataattcttaacacatttggttactctgaggataaaagtggaggaaaaaacatgcagaggatagtccggaactccccatgtagatcccattattaggtaactgaggtacaagtatcttaggctactggtccgggcaggctttgctgaggggctccgtgcagcttgctggtgcagccgagcaaatgggcctgtagccgactcttaatccaggttggtgctattcaaagagatcatctttcacccgagggatttctgggcatctattttgcggatcagaaagtagagaaagaaggtaactttgccgaaagctagtctggggagttagtagctgatacagatcagcatttcctaactatgagatttcataatattctctcttgtctcgattctgagtcactggtgcctgctgtggtggcattgttcatgaacatgtacagttattgggaagtgatcttgtctttcctcctgccttcaggcactgctacctaaattacaccccgacagatgtattcccattcttctttaaaagactatgtcatgagctgaactattaagttttaaagttgataagcatcaggctaagcatatttttcctgccatctcccacggaggtataacattgttttctatacttagggaatttaccaaaaaaaaaaaaaaaaaaaaaaaagttggtatctgctaatgggtcaaattagcaggatgttttgaaaactcagtggaagaatagctcttcctgcagatgcatgacctggtagaaatccagacattgggctccaccaaactcgaatgatacccaataaatgatgagaggaatatccaaagagttaaatgccatgagaccactcaccccctaaactctaaatccttgtatgaccctgagacaggcaggcagtagggctgcaaggctgagataagtactgaaaattggcccatatacattttgttttaacatagctccttcctttacacttttctgtacccctggcctgaaggctctacagcttgttacatactgatagctaagtaaatgcaatcaacattccatgctactgcctgcagaaaaaccgaaattgtttactgcctccaggatgttggtaaatatctggctgtattttttttttttttggcgggcgggggcggggggaggcaatgggtaggagaaagctagtatacagtgtcccaatttacattataaaatgcaaattttgtactccagaataagaaacaacttagagtagacctgtattgttccaaaactaatgagaaattatcatgttttctatgtgtagaaaagttttctcttcgcaatggctttacatattttctgtagggaaaaattctatttataaaatagcctgggatatggagaactcagtgataaaaggggcaagaacattttcagattgttttaccctgctggaatgtagcatgggaaagctccttccaaaaggctattacctctgggcattctggcacagttggggagtgaattggtaagataaaaatgggacgaaaatccctattttctgttaaatacaaacaggctcagaatggggcatcctgcatttaggattagaaacttcattatacaaaagcagggtggagaaaccctaatttgacagctaacccaagagtgtatggtgaccacaagattaacaggggccagcagtgtgacattgccattcaaaaagctggtgctgtagttgggctgtggtctaaccacagctgggtttttttttttttttttttttttgcccagttttgggcacagaatgctaagaggaacgccaacagaatggagactcgatgccaatgaattgggaaatcatattatgtgacgggcagttgaagaaggcatgtctgtaaaattgaagaagagatttcttagaatgacctcagtaacaagcttaaatatttaagtgtctggtgaaagtaggggtgggatagtctctgatgtgctacaagatcgaagaaggagttaagtccttctctagagcctcaaacccctgctcagcatgaaaaaaacaacagaaacccaagttaacatctccttgcaatatctgatctgtttttccaatacatctgctcatcttgtttcaaaacaagtagctgtcaccattcttaaccctgtcgtccaaaccagaaaccgggcatcatctttgactggtcccctttactcagggggaaaaaaaaccatgtcttttaaagtcagcgcctataatactggtctttggtttatctccaataactcgattgttaacagcccttgaaggggaggcaatactgttaaacttgataatttctaaagagttttgagctatttagcacgaagtgatgccaagaaaaaggaatactaacattactcacagcagagggaaaaattttatatcctttctgaaggccaaggttaagttctgtgtgactcagcacattgactttctatatgaccctaaatcccttctatttcctgatctacttgtcttgacctgtttcatttccacaccaaaatagtttcattaacacagcgatcatgctcaggagatagtggctaactgatgtaattaactgacatgtcaaaggctattggtttattgcatatgcaactgtctttcctggtgggaagatacagtttctgctgacataataggtatgcaaacatgccaaattgcccaataatctgcccccgtgatggtgaggtgtttgcggccattctacttacaggaacagaatggcggatctgttactatgttctcctaaaatgcagctggccaaaggtgctaattggtaaacagttaaaatagaaagaagagaaggcaattcagttttgggccttagtgagttttttttccttttctttccttaaaaaaaaaaaattgtgcttttggcatgctaatgcatgcatttagtctctgcaagaaatttccatttaagaaagaatttaaaaacatgaagtgctcaatccatatctcctaaacaactaaaaagactgcaatttcaaatgagaaattatgttgcaaagaagaaaaaagttgtttattatggctcaaaattttaatcacccaagggctgtaaagttaaaaatagacaattctgccttctgtttatggtaaacttggctgagtcccggcaaatttcaaagctgaacatactgtatgttatttttgcttaattttagattccacattttaaaattatttcttacaagaagcatatttcaggatataaacttagcctgaagaacagtattcttgatttttgcccatattgaaactcctttgaaaatagtaaactatggttttgggattttcctattcccaagagtccaaatgggtacctttctaagtcttttacattatgaatgaacacaggattatgaaattgtaaaggttactttctgctctctaattcctttactcgtaattttagttttcttaacggtataacttgatgcaaatatatacacagtagatactaactttcactgaagtgttttcgggagggaggggcactttacaagatgtgttgcctttagtttttccggtaaggagacaggaagacacagacacaggctcttagggcacatggaaagcgcctgcccctgtgccaagaacttaagagagagccggggatggaccctccttgctgtggctcctgaacagtgcagcctctcttctgatgcactcaccctggcgaggagaaccgcttgtgtggcgactgcttggcccaagagcgagtaggattgttgactcaactctcttcgtgtctcctcagagaggaggaacacctggcttcacctgtttacataactcttgttgattcttgtccctaagctcttccagaatgctcttttgggcttttcctcaaaaggtttttagaagaacaagctttttggggtggcaagaaatttaggatggagatttttgtttttaacctattagtcagcgtggcatcagagaaccacatgtgccccacagtcagtggcatgctcagtaaatatttgttgaatattatttaagtgaatgactgtttgctgaagaacaagatttctctgatgaccttgacaaacgtatgtttgtgattaagttaatcatagctaccacttagaacttcttactcactagacatgtagctgaacacttcatatgtcattctgctttttgtttttttaaagacagggtccctcccactctgtcacccaggctggagtatagtggtgcagtctcagctcattgcaacctctgacccccaggttcaagcagtcctcccacctcagcctcccaggtaactggggctacaggtgtctgccaccacacctggttaatttttgtatttttttgtacagatggggtttcaccatgttgcccaggctggtctagaacttctggactcaagtgatctgcccaccttggcctcccaaagtgctaggattacaggcatgagccactgtgccttgccttcatatgttatttctgatccactaggtttggaacctatcccaggacacctggccatatagagtagctatatcgagtctatattcagcaagtgcagggtaagctctgattccatggtccttccaatatgccataccaccgaggttgagaaaggtggtgttaacagtacccatacgttgacataaggcctctgagaggccaaaggatatgccacagtattctttaaggtgcttaagcccttaatcatgaaatgttttcctaggccacagtaagaatctacttagtttacacacaattctaataaatccggttatctgtttttcaaatacaaagcagattgattcattcagcaaatattttctgaatacctattatgtgccaagtagattgttctagatacagtgaacaaaaaagaatccttgctctgacagaggtgatgttgcagattaatagatcagtggttctcaaaagtgtagttcctggatcagtggcattagcataacatggggacttgttagcagtgcaaatgttggtccccacccccgacttactcagtgagaagctctaggggtggggcctgattttaaacaagccctgtagatgattatgatgtatgtgaaagtgtgagaaccagtattctagaagattttaaacaatttgtgttcctatggcagatagctctctggagaactttgtctcctgattcattcccagactaccgtgtgtgtgtacatgtgagtgttggggtcttaccttataacggcatttagtgattggcaaagctcagatgctgggcctctatggggcagaggcacttggacatttgtacctaaggatgtgggccctggagttacatgtacctgaattcagattcttactttgccaagcacagccacaagaacttgggagagttaggaaaactctctaagccttagtttcttcattgtgcaaatgaggttgacagtaataggaccatacctccatttgtagcatggctacttggtacaaagaaaatgtccagtaactagtaacaattgcttttctctctccaggatccagcacctggcctggcacagggtacatgctcagagaacaagtctttgaaagaatgggtagatgtttattttcctttgtattagccattagctcaaggtctgcagctacttaattccaacctgggtccatttttagcagaagaaaaaagaataatgggactcagcatcaaggcgcacctgacacagagtcctcttggaaatgtgtgacctgcctcagtttagccactgcttttacttcatcctcatcagtcagagtatgacattgccttcccctttacctcttaattttggaatatttcaagtgcctctaaaattttatttaattaaggggcttccaaatctgcttgtagatattttattcttgaaatgcttgtggcattaatagtaaatcagaatcagacctccacctattttgtgccatttcagcactaagccaaggagaaaaattattgaggaaattaatgcttcccttaagcacagtaggaacacgaagctaacatactgccgtataacctgatttcactggtattctttctgaaatttttgtttttctatttctattgcatattggacttcatggctaaaacaaagtgcaattatgaggaggatgttttctcaaaatctgtagggtctggttggtcacataacctttcagaagaaacattatctactggatgacttagatgttattcaccaatagattatcaaggtttatctccagatgttcattaattcactaagtattaattgagtatctactatgtgccaagcatcgtcctaggtgctaaagatatagcagtgaatgaatgggacaaaagtctctgccctcttggtatatacttagttactttctttttcacacatgggcatgtgtgtaggtgtctctggagtaatgcgttatatgcaggtgttgagcctagggtggtgttgggtgcatcatgggcactcacatgttaatttcctgcactgtagatgattgctgattctcagtgatataatccagtcaaaccatttggcgttcttctgctttaaattttattggtgaggtttaactcttcattaatgaacgctgtcacattttctctcttctctgacatgtcctggtgccctgggtttgtggggtcaagtcactgccgatttaattcaactcttctttgtatgactacaagtcctgtgttttagtttcctattgctgctgtaaaaaatcaacatgaacttaatggtttacagtaacacagatctattccctgataggtctggaggtggggagtctcaaatccagtgttactgggctgaaatgaaggtgttccgaggactggttccttctgtaggctccaggggagaacctgttccttgggccttccagcatctagaggctggctcttcactgcatcactgcatttgagctccgcttccttctcctggacctttgaccctcctgcctcccacttaaggagccttccagttgcatcattgggcctgcctgaataatccagggtaatctgtctacctcaagatcttcaacttgatcacagctgcagagtcccttttgttgtattcatgcattctggacattaggatatagacatcttggtggttggtcattgttcggccgatcataccttgtgagaaattccagtgtccctgggctgagctgctaaggagcaggttttattgagcagtctttcccattctatgaaacccaacccaggagaaaacgctctaaaatgcaaatgttgctaacttggcagagcctaattatatgtgcacaactacctaaaattttcttaataattgctctctgttccacaagacttggctcaaaaacccctcctccaaggagccttcctgaattttcctgggcttgtatagtactctgtgtttgtgattctgtgtcacgctctgtgtaagtgactccatgatcaaagctttcctgttgtaattgtgtggatttacttgttgcccactgtccccataccctccacccccacatggtgtgctttctccagaaagggactacttctgctgaccacacagaagacgtgtgtaaagtctgtgtatcaatgaatggattctcatctttcatagttttttttttaaatagttttatgtgtgtttaacttaatttcacttaaaaagatatttaccagaagctgaaagtagggtgtgatgaggttgggttcaggaaggactggtatcacatggcttccctaagttgtatattacattgttaggacacctgacagagctgtggattagtgaatcttacggatggctcttttcagttgaatataattctgaagctctgcaccattcttcccactgtgttgctgttaatctaccataaaccaggtagattctgcatagttggaagtgatggaaatcaaggtgaatgcctgattctttaaatctttttttttttttgagatggcgtcttgctctgttgcccaggctggcatccattggtgcaatcttggttcactgcaacctccgcctcctgagttcaagcaattctcgtgcctcagcctcctgagtagctggaattacaggtgggcaccaccatgcctggctaatttttgtatttttagtagagacgaggtttcaccacgttggccaggttggtctcaaactcctgacctcaagtgatctgcccgcctcggcctcccgaagtgctaggattacaggtgtgagccactgcgcctgacctgaatctttaaattcttaaaatcagttttagtcaccaaagaagatactctgtagcttaataactttgagttactgtaacggaatcaagtcactggtattgagacatttttatttaaaaattttaaattagaatcttactatgtggaaaaatacggtcattgttggaaaatcattttgcctctttttaacagcattcaggcagtttttttttccctttgaaaatagaccttggtctgtgttgttggaaagcatgtaattttcatttgttttttttcacctagtagtgcttaatgataccatgtgaatttttatagtcccagctgcactgaagtgtgtgccctgaaacttcggttggattaagaaaagtagcttggtgtgagggctgaaattggtgaaatgggagaacacagggttgcatctatatatattgcaattaatattgacgagtgggcagaagtccaacattatcctagggggttggctaatgttctttgtacaccaatgcaagtgagtcttttccctccaggtgtgaatagtttaatttagtaggtcgattagtagaagcaaggggtgttttcttgtattccagtttacattatacactcaacattaactagctgtttaaggtacagtgcattgttgagtagttgtggtacaggtatcctgagacgttgctaacccatcttggtatctccagggcctggcatctaatgtagtaggtactcattagcatttgcaacatgaataggagaatgaatgagtggttgttgtggcaaagtctcttaaaaatcctggtccctgcgtacctctgtagccttctcatctccccaccttctagcaataatattctatttgtagcttgttaaatactccacattctttccggcctttggacttttgtacatttcattccctctgactctcacaccaccttccctgtcccctatcccctttgtctggctaattcccgctggttctttatgacttagcaccttctagaagacgttttaggaggcatcatagtgggtattttgttgaaggcctggtttgtttttcatatctctatgataacatatctctttgggtaacaacagagagctgctgactagtggcaccgttgaaagctgcatatctgaagcttcttttcaggagaatgtggatcatttcaggtgcctgcatcatttgcatgtacatcttccaaactctattggtactttccatttagatatgggcagaacatgatgctacagtaactgaaacagaagttaagttagcagcagattctcttccatttatagcatcagtatcagggtaaaatgggaagatgaaggaaaactattgatgaattacctttggtacagctgatactaaagtgggtaaacaggcaaaaagaagttgggaaattgaaccattctctttcttttctttttttcaaaattagagacagggtcttaatttgtcacccaggctggagtgcaatggcacgatcctagctcactacagcctcgaactcctgggcttaagggatcctcctgccccagccgcatgagtagcaagtgcatgccaccatgcctggttaatttctttcttttctttttctttctttctttttttttttttttttggatgagatatgggtctaattatgttgaccaggctggtctcgaactcctggcctcaagcagtcttctcaccctaggcccccagaatgctgggattacaggctttagcaaccacacccagcctgaaccatttcctttctgatttaacttaggaaagtttgctgcatagtaggagctcagctaacatttgctgaggatgaaaaaaataaatgaaccaagtttgttttgtttgcatctttttccttttgctttacaataatatattttttaaaattccctgtcttttctactacacttcttttggccttcatagctctagccccagactatacttagtgcttttgctaagactgactcatcttgtttgattgctttagtgatataagattcttgtatccataggaatggtgtgagactgtatgcctttcatgtttgcaaaaatgtaaaccagaagagccagttattggtaccagtaccaactaattcctcagagctatagggcagtattaaattactaagccagtgtggaaacagcatgatctaatggaaagctaattagcctttgtgtcagatgggtgtgattcaaatcttgtctgtactgctgatgggctgtgtgactttgggcaagtagcttaacttctctgagttcccctgtctctgttttttcatttgtaaaatggagtggaggggacaatattaacttgcaggatggcttgatgatgagaaatgataaatgtcttagtctatattagatcttcagtaaatggtagttgttttgaccactgttactgcaatgagccaaggtggctataagcccttcagtgtttcagtaaggacaagcttacaggtaaccaccaagatcagggcagaacagctgatttaggtctaaacaggttccatcgtgtgtcttcaaaaaggttttcctttttttcctctggagaaaattcagactggtttaagaaggaaactgagagcctcttccctccctatgttctgagtgtttcagagatggccagaaatggatactagttactaagcaagacctttaaaaaatacacgttacaaggcaggttggtatgaaggaaagagcactgacccgtgagttattctcgcggggccaggctctgctccactcagctctgtgttctctgccaagtccctttagatcaatgtgtcgcatgtccccccattgtgagttgagtacattggaccaaaggattatagtttgttttcttcccaggcaagtgcctcctcctgatggggagttagtatgatgtgggtggccccagtaggactgggctggtcttactgttctaagaagtgttagcagaaaaatggctaggcattggagtaaccctgtgatttgacattttggggcatcctttcatggtacgatacacctggccaaaagtctcccagctcagaaattctataactagaaatgctttgaataaatatatactgagaaggtattttggggggaaattttaaaattcttatctgacttggctagagcaactgcttacgacactggacttcttaggggtatcgataatggttgtctttgaatggggagtggatttctcagcttcctgggaacagcaacaaaattcccccaacaaaccccagggtgtctgaagcgcctgctttcttctcaaagagcccgatcgaatactcttctgtgggctcaagagctatcaacagtattgaacagttagactagaaggatgggttgagaacagttgctccctcaaggcttggaaattaacaaagaccatattagtaagaatggggagggaggtgggaggtgaagagaatgagggctgggaggagcaattcggaagtggagagggtgattggaggggtttgtttcccagacagttttcaaagaagagggatttgtgtagtatgccatgggactgaagatgcagtgcaagaccagttgatgttcttcttttaatcaaccaattaatttctctatcatgtttcttttaggctaacgaagtgtcttctttcctttatcatggccattgatagcaagagcttaagggaatcttgcctccctgggctcaggataggctggagagaaggacacacataagaggaaattgacattttgcagtttttgttgttgttgtttgtttgtttgtttttttgagacagtctccactccgttgcccaggctggagtccagtggcacgatctcagctcactgcaacctctgcctcccaggttcaagtgattttcattcctcagcctcccaagtagctgggactacaggcttgcaccaccgtgcctggctaatacagcttttttttttttttcttaattttatcataggtaagggaagacgatccaatgtgcagagaaggctcaggttttcattttagtctgcgggtgattgatttctttctttcaaggggctggttgaggaggtcagagtcttagaaagggagaagaaatcagggaaaaggagaaaagaaggaatgagatttatgaccctctggatcccagattttatgtcgcgtaaccattcccaatactggaagttcatgacaccctgagaaacagccctggaactcagagcagtgatctgcatgcaaaggcaaaattaaatagtccagcaactgctttgaccgagagacacacatagtactattctgggtcctgagtgctgcttccctttcatttctcccctaggcacagattccactggctcacagagtgatgagttagaccacccagggccacttatgttatactgagggcggatgctgatagtgcttatagaggaattatttcaacaatgagacttttccattattctttctgcaatcaccctctatactcagaatgtggaaaccttggcatctctcacttaagaacactgaattcatggtgttgctcagagagtcctgtcctggttccataacactgtgataataactgaagatctttaaaaatgtatgtatcttccatttttattccatatggccccttaggtaacatgacccaatggggccattaaatgaccctgcctacacttggattactcagtacaaagcaaatttatggttgtttattctctcctcctatcagctattagtgcctaatcatatggtctatcgatcatgagattaatcgcctgcccaaagaggcagcaggtcttgtggaatgctgcactgcgccagactgaacttcaaccttttatacaaactggaggagtcaaaatcatcattcactgcctgaaatccttgcaccctgggcctcctgcaccccaggaggtaaatccctgctttttcaaacagtgtactttgcacttcctttccttgtgtaaaactttacctcattgattcaggcaggcacttgtaaataaaatcctttccaaggcatcctataaataatgatctaagctgaaaatatgtgggctttattatacaaagccccatagtgctgccataattaaaggtctgtcagtatttctattataaattctcattttagaagatttatcactgggctattaaagttttctctaagactttccaagagtatcatgatctaaggccttttttttctttctgtggaatgtgttgctttgaagatataaaaaataaagtccagaaacattatcacataggagtacacacatgcagagattggacactttaaaatttgagctctgcctccactaaagtggcttctgtttgcctcttgtgttctcattgcatttatgagaacagagaatcattgtagggctaatactgtattgtaatatttgtttcctggtctgtgtcttttactctgaggagagagagggcagggagttaaatcatttgtctttctggccctggttccaccagagggccttggcaatataagcactgggtttgttcagtaaatgagccccagggtgagagtcaggaaattttcttcctagtcttcatctagtcattaaaggtgaggagtgaattcaggcagtgaatttaggcaagtccctttactttcctgaaaacaagttttctgatcaatgaaacgagtgtgttgagttcagggctagtaaatctgtttttggtgggttgaatactgccggcacagtgttttcaaacacttgaattggaatgtctttagatggaatctgtgccttctagtttgccataatccccactgttccctattatattatgttgtatcagcagcctgcttctatcatttgcctgcagagtctataagcatttatgattccttgtaattattgatcatgtggtcttttgttgctatactaagggtctaaatctgattcaggttagccgttgatgcctttgactgtaactgtaattctctaactttcaacccttttatcatcaaggacctcaactattattttttgttccatatttgaaaacttttggtgttccagacacactgcattggttaataactaattttcccgttgtaaaaacagacacgtgtaactgaacacacaaatgagccatcaacagtatgaatataaaagtgtttgtgcaatgagttggttgacgtttcagctagcttgttcagttgtttcatgggtaagtgtatagtttttgtttgaagttttgatatatgaaaaatagttccgaggtcttctgccttattagacatgtgatagacaaaggattctaggtgagaacttagtttattcttttatgagttgctgaactgccctggtcattagaacatcaagtaagttgtttatccacatgcagttcatgtcttttcagttgtctccttattggtcagcttagagagggctctacaaaacctggcttttacattcagtgagctgaaaagagcttcctatatgagtttacccaaaggcccttgttacattttctccctttagtcaagagtactttggaattttacattttctccctttagtcaagagcactttggaatttgttaaaaggattgggagacaatttgaaaacttggctctccagttaagaagaatcattttttacactttaactcagactgttggtgaatattgtaaattgacaatttaaaaacacacatttgttttattttattttattttttatttatttttgaggtggagtctcacaccgtctcccaggcttgagtgcgtggtgcgatcttggctcactgcaaccaagtgagccttggctcaccgcctcccagattctcctacctcagccttccgagtagctgagattacaggcatgcaccaccatgcccagctaatttctgtatttttagtagagacagggttttgttgtgttgggcaggctggtctcaaactcctgaccttaggtgatccgcccgccttggcctcccaaagtgctgggattataggcatgagccaccacacccggccttattttatttttgagacagggtcttactctgtcacccagactggagtgcagtgacacgatattggctcactgcagccctcgccttctgggctcaagtgatcctcccacctcagcctcctgagtaactgggattacaggcacacgccaccctgcctggctaatttttttgtatttttaatagagatgggttttgccatgttgcccagactggtattgaactcctgggctcaagccatccacctgcctcaccctccccaagcgttgagactacaggcagtgagccactgcatctggccaaacatacatttaaatagagcagatgaaagatctatagtgtagaagtaatctgcatataaaccagtcttaaattgagacgtgacctatgactgttaaagcagtccacatcacacaaaaataaagggcttggaagatagcagcctggtttaaccaggttagatataatttaacaggaagagatagtgtctacattgttgctaaaagcttaggctctggggttcctaatttgggtttaattctgtcttggttacttgttaattctgtcaccttggagtggttccttaaatctccctaggccttggtttcctcatttgtaaaatggggataataatggcttaccgtgtggaataaattagagtaattcatacaaaggatttatcatcatattggttatagaagaaacaatgaatattcatgatcatttttatcaagaatataattgaaatatatttctgagcgttgaggtttttctcttaaagaaaagtgtaaaggtatactttcttaagactgctcatacatgctggatcacccatatacatttccaggaaattgtatgttctagcaattctatgttccaaatgtgctgctttcagttttttcgagaaacaaatgatgtttgactttaaaattctagagttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggtgcctgtagtcccagctactcaggaggctgaggcaggaggatggcgtgaacccgggaagcggagcttgcagtgagccgagattgcgccactgcagtccgcagtccggcctgggcgacagagcgagactccatctcaaaaaaaaaaaaaaaaaatctagagttgaaatttttctcttacatttccttttccctctagatcaatcccaattaaagtttcattgcaaaagtttcacaaactcatattggcattaattattattggtgtgctggtgaaagtcctaaagtgagttcattaagaattaaaaaccttggctgggcgcggtggctcacgcctgtaatcgcagcactttgggaggccgaggtggatggatcacctgaggtcaggagttcgagaccagcctgaccaaacatggtgaaatcccgtcactactaaaaatgcaaaaattagctcggcgttgcgtgcgcctgtagtcccagctactcggaggctgtgacaggagaactgtttgaacccgggaggcggaggttgcagtgagctgagatcatgccattgcgctccagcctgggcgacagagcgagactgtctccaaaataaaaagaattaaaacccttgagaaaactttaaaccctcctggactcatagagctggaggggacctaagaggttatctcctctaagccccattttccagataaggaaagtgtattttccaaggtaaaataagttttcaacagtgaatatccttcataatggctttttaatttgtactgtcactggagtcagccctcatttgccatgttatgattatgttcttcttgtgggacttgtatgtatttattagagaccattgagacgtagcactgggcattacttttgtggcaaaggcaccagggcagtaatcattattaatggatttcattatttgggagagcattttactgactatagagaattcattgcattgatctattgtgccacagttttattataccgggtagtttaaaatgatattctctaaactgttaggctgaaaaattgtccagtgttggcagttatcccatcagtaagacattccttttactaccgaaaatacatagttctgtcgaaagagaccttttgactggtccccagtgccctgactgtgtttaaatccctcactagtgaaataggaggattactactgccatcattgttctaaaacaaacttccttttggaagataacagcagcggtaaatcagatgttgaagaaagtaccagcttaacttcactttgctttaaaagggtttcctctttaattgacaagtgtcatgtataatagggcatggcaactcacatagtaaaccttgtgtggggctgcctgctggggttggagttcttaatgaacatacaagtgaatacactgaggcaaaaaaattaaagctctccaactgtggggtattcattctgttcactgtggccagtgtggtgatcagtactggccacaccagtggccaaagagaactgcattcatcatgtggctgttctatagctgtgagctgtggtgactgttatttttcctagtgatagttttcagtgacagcatagattctggtatcatatccaaggaataaacaaacactgtttttggctttttgtttttttgtttttgacataaaaataataagctatttttggcatatgcagacttttcacaaagtgattgttttcttgagctctggactacttggtaacattcataagttccttcactttgtagctccctctttccttccctccactccctgcaaaagagagcagaactgatttttcagaggtgatgtttacaacagttcaacacactcgaatgagcacttagaataatgtcaatagaggaagaaaaaaaaggacatattattatcaaattaagtaatggatgggcagtgatattttatttattaaagcttgtctgagtaccattggaaacagagtatgttggttctgaagtgcacagattagaaaggaatgttgagtttggaaacgtggcagcctgcagcactgtgtatggtttaaattaaacctttttttggaaagcagaatagctgtaggccacatttaagggaaaagccacagcagagtgagctggctgtggtttttcttttactctgtaaccggcccactttcccttgttttaacacagaaaaagactttggactccttcagaccaaccacatagcttctctgctgaccacaaaaaggaagcttggcgtagaagccataggattaatacccactgtctcttaacccaacagagtgtgaaaactttcataagagatttctctgggcagactgacactgtggttggactttaaacattttaaatcaagcacaactttgaattgcattatgccacagtgctctgtaaattgttatgtgtgatcccactgttaaaagttatttacatgaatccccaggtttcagagggataaaccactaacagctttgtgtatcttataaagaaatacaaagagaattaaaggtatgcctatgacacattatctcagatagagtaggtagatcatagtcagattttattattcttaagcaaatggaggcaattggcttttggcagaaaagccttttcatctttgaaaataataggattaagattgtggattctgttaatcacttgatcagctttattaattaaccacatttttaaattagaaaaaaccctttttactagatgtgcatctttcttaataattttacattgcaggttttatttaatatactgatctactcaggtattataaatggttgtttctatgtcctgcacattaattttaataattggaatcctactaccctgatttactaatcatgcatttgtacaaagcaactctgaaatgaccaaaaataaccacaaaaaaaccttttgtgtttgtatttatatttactcattcagatgcctaggattaatatgttttacaagaaatcatttgaatttacatcttaccatgttgaattaatcagcttttcataagtgcactgtctcagtattctggtttctatttaacagagaatctcaatggaagagattgatttgaaaagttgaaggaaaaatcgtgcatacatgtttcaaaactgtggtcttacagtaaccacagagttaattcttggttgactttatgtcgcgagaggggttgatttgctgtcattagagaaattggtctgtataacacttcctgtatgtgaagaaatgcagttgtcatcatgcctagaccattaaagcagtatttaaatacttccagttgtgaggagccatgcatttattttggttattttcccaggtgtcttaggagcagctgttttgtgctttactgaacttaatagttgaagaatgtgggaaagaaatggtgtactttctgggtaaagtattttagccaccctggagtagttgcattgcatcttgatcttttttcatcttggtagaattatactgtaactaattgaatccattgatcactgtcttgttttttttccatcttcttctccgaggattcatttcataggggtctatacatcagtcaagaaaatagctaccgaggaattaccgagactagtaataaaggtaatttaacctagtttaatattttttttaaaggcaaaacactgtaaacattttttacctggtgagagttaacttcttaattaggccatgttggaaaacaaatcaaaaagacacttactggtagttttcagagagtgagagaaaaaaagaggcaagagaaagcattgatcttggaattagatgacctggtttctaggcctatctaccccaatgcttttcaaacttcaatgtgcatacgaatcaactggggatcttgttaaactgcagagtctgaatcagtatggttgcagtgggcctgagatgctgcatttctgacaagctcgctgagacatccctgctgtagaacctctgaccacaccctgagtagcaagggtctgctttaccacttagctaactttgtggctttgggtatactgtttaacaactctgcatctcagtttcctaatctataaaattgggatattaatctttgttctgcctacctcattgggttgttatgagaataaaattagataatgtagatgctttttttttttttttttttgagatggagtcttgctctgttgcccgggctggagtgcagtggctcgatctcggctcattgcaacctctgcctcccgggctcaagcagttctcctgattcagcctcccaagtaattggaattacaggcgcctgccaccatgcccgactaatttttatatttttagtagagacggggtttcaccatgttggccaggctggtctcaaactcctgacctcaggtgatcctcctgcctcggcctcccaaagtgctgggattacaggcgtgagccaccgcgcccggcctgtagatgtaattttaaagtgtcaaataagcataaggcagcaaggacatttgtttatagatacagacattctttggatacctttcatcaaatcagtgtgggctgttctttaataggaggggcctggaactgtgaggcaggagaagggaactggaatccctgcctccctagtacccattctgtgcctttggccaaatcatctcccctggtcccctgttgcgtcatctttaaaataagggcttgacctaggttagtgctcttaaagggtagttgcaagactagcagcatcagcatcactgggaaacttgctagaaatgcaggttagattcctagccccttccgagacctggtgaatcagaaactctgggaatgcagtccagcaatctgatttctaatgagctcttcaggtgattctgatgcagctaaattttgagaaactttctgaagtgtcatccaactttgaaatgagatatttaagccttctctttataggttcagccaacagagagcctatctgtgtgatctctagacactttcccatctcccaggtagaggaagattggggaattgaaccttctgtgattgtattgcattgagcatgtggtaaggaggactgaacttggacggttaaaacctcacctctctggaactcggaatagattataattgcattgacttacactggtctagcttatccagttttggggctgctttagtagcccacaaacgctgactaatgcagatgactgtacacactgagaaagttctcttccattttagtttcctccttactctcttcctgttccccgaatggttgtcatcatgatatagcaccaagtcacattttatagacttttcaataactttctaaagttgatcacaatctagattatttgcattgttgtgagatgagggaaactgagaaagtaaaatacatgttttgttttgttttgagacagagcctcactctgttgtccaggctggagtgcagtggcacaatctcagctcactgcaacctctgcctcccaggttcaagtgactctcctgcctcagcctcttgagtagcagcgattacaggcactcgccactatgcccagctaatttttgtatttttagtagcgatgggatttcaccatattggccaggctggtctcgaactcctgacctcaagtgatccgtccaccttggcctcccaaagtgctgggattacaggtgtgcaccaccgtgcctggcagtacatgtttttcttaaagtcatttacggttacgtttcctttatctgcagtttttgtttgttagtttgtacatttggaaatacatctgaaaacttaccaagttcaagcgctagagagcacaatctttatgtacagagaagacctcctcgatgaggtctaacaacttctgttctagacacaagtctgatttttcattccagagcagcaaataaagtcatagtggacagctgcttcagtctggaaactagaaacaaacaagaggtgttagctggcagctgaacaatgaagaaagacatggagacactgtccaagaggtcgagatggatagtagcttgagatcctctctttctctctagacatgcgccatgtgcaacacacacacacacacacacacacacacacacacgcagacagtctctgactttcaacggtttgactttatgatgagtttatcaggatgtaactctgtcacaagttgaggagcatgtgtttatgtgtgtatgtgtatccgtatacatttacatttatatatacacacacacacacccctctataatcctgtatacttaaattcctaaatagttgtttgggtgttcactatattggaacgctttaacttgtgttcttaataatatctttaggaaaagattaaagcatgtttctgcatataataatattagtaacaaatgatggaagattttgctccaaaatgagttaatgtagaaaacaggtagtgattaaagtggtgaatgtaagcaattttgtaaatttataaagtcatagacatctgtagttatgaaggacctcatagataattttctccagtggtttcaaatattatttaaataggaatgtttccttcaggaccaaatctgtggagaagctatgtacatgtatttatttttttaagttgaaaagtatgcgagtactggatccatattattaataactttggcccacctgttctttctcccagaagcagccccagttggaatcagcccctagagcgaggagtcacctgggaagcttgttacatgcagattctgattctgtgtgtctgggaaggcacctgagactctgcatttcagataaactcctaatgtgttaaacatgcattggccacattttgagaagcaaggccctgggggaaactgtgcacgtagttcgaaaacctttgatgggttaacttcttcatgtttcaaatgtgaaaagacagagttataaatgatctgccaaaagccacatgcttacctggggtcttgagtcttgggaaggctgtgttcttttacccaaggcctgggtgggatggctgtgtccttaccctttgggctgaaggaggcatcctagtaccagggttccacgggcactatccgtattcttagtttctatcatgatagattatgctgggaacttgttccttttagcccactatctgtcccatggaaaacagtactctgaatcagaccccatggagggtggaacattctgattagccagcaagggcagttaggcccgtagctgtggtgtctgctgccacagcagaatggataagcagttctcagccaccaccccccacaacataatccataaaactctttcaacctttttttttttttttgcatgtctagtgtttgcaaatggaaaatggctgaggaaaaacagagtgaaagtttatataaaatatttataccttaaagatcttttatcttgtgtcattcaagagagaagtgaaaaatgtattgggagtacattatcaagagtacattataaatttaaatctcagattgaataatatcagctgctaatgtgtggagctttggaaatgagtcacttttgaatctcaagaacttaactgtaccaggtcagttacacttaagaaggaagtgccttttgaaaaaagaaaaatcctataccggaataaagacttatactaatgggcattaaagatcaaatacttgacataatattcatgttagaatgtagctacataggaataagttgtaggatctgagacactttatggaatgtttctcaaaaacaatcaaataattttggtcttttctttgtgaagcaatataacctgtggttacgagttatgtgtcttagaaagacttagatttgaattctctgtctgctgcttgttagctgtgccattttggatcagttcttttctttgagactcactttattttaaagcaaagttaatatacctacctaattggttttttttgtaaaggattaaacatcatggtatttgtaaagcattcagcactttgcctagaattttatagttccagtaaatagtagctatttttatcattattgtcaccatgatattgtttttagacctaactagtattgcatcattctttggtgacctggtggtgtgctatggaagcgaaattggtgtgcctgttgaaaaagttagtagtcagaaaaaaagacatacttttataagtgagactgtgactattatgctggacacctgcattctaactagcaaaacagaaaatactttgttggttttaatggtgctttgtttttatactgcatggtatctatttttgtatgctggggtcttaaaatgcttggagcatctagagaggtaactaaaggaatgaagtaggccatagacatagcaacagcccatgtcccattgaaaggccatgagtcccagttgaggccccttggctctagccaattggtgctgtgtgaaaatctgggcccagtgttgtcagttcttttaattttttcctaagaatctggaagtgcagatttttacatgaatcataggatgctttaaataattgcagctgtatcttgagaatgctgttggctgcaagaaagaaaaattttagtttaacagtggtctaaacaaagatttttttttcttacatagcagtgagtccagcagtaatagctagtgtttttatttgctcactaataccaacaagaatttagacactttccatttttctgtcctgacatgcttcatttgttgacttgaaaaaaaaaagtgcttgtcatttatggttgccatatgtatgttgaaggtaggataatgaaggagatacattagactagccttatttattccatttatcaggaaagtgaaaacttttccagaaactacacaggagacatcccttatgatttactggccaaaactgggtcattctggctgcaaggaagcttgggaaaatgtctcaagctttcttttttttgttgttatgtgttttttttgtttgtttgtttgttttttggagatggagtattgctctgtcgcccaggctggagtgcagtggcgtgatctcagctcactgcaagctctgcttcctgggttcacgccattctcctgcctcagcctcccgagtagctgggactacagccgcccgccgccacgcccggctaatttttttgtatttttagtagagatggggtttcaccatgttagccaggatggtctcaatctcctgacctcatgatctgcccacctcagcctcccaaagtgctgggattacaggtgtgagccaccacgtccagccaaatgtctcaagctttctagcctctacagtgggagatggtgaagaagtgggaaatcattgttgcacttactagtgaacagttgctgtctggcacagcagctaactcaacatgaaacccaactgcaggacctgaagaccctgtggcctgcagtatttatcaaaaatcttcagattggggattataaagtgaaggtatcatttgggtggaaaggaggagggtcggagaggcagccagtgctttatttttttgtttaaatggtttcgtattatatatacgataggtcattgctaacaatgtgcaaactgttgagggaacattgtataaatttatttcttggaaaagtttatttagagttttagtggagaagctagagaagaaaataccatttaatgttatttctgtactgctatattacattttaatatatgaattactctattttttaaaaatgatggataaactacacttccctttagttgtttttattctgagataaatgcctgttttgtaaatcattgttacctgattttggtaatctctattagaaagaaatctctttttattaatatctgtatacttaactcagacactgggaaattcttgcaaaatgctttacaaaagcagccattttaagctgattaaaagtatattctatatgcatgtatgtagttgaagtgctaccaaaccacgtatgtatttagttaactaaactcaagaatcatggaagtttgaagaactccaaatcacagctaagaatgcactaaaggaaaaccatatctgtttgactccagcaaattgactcgtgtgatatttttgcttacacctttctgcagcttaactgctgagttagctgttctttaatgtccttgacaaattcaggaagtcatcacatgtagataaattgagaaaaatatttctgccaatttggtcctgatcatttcttcttggggttataaatttgggttttcatgatctagatgttaataaaaaagaaccccagataatctgaagggttactcctcaatattactatgataagtttagggtctgtgagttggctgcctactgagtacctaaaagcatgggaacttttacaacatataatccaatacgtaatcactttgtcaggctgagcaagttagtggaatctttagtaatactacgataattaaatagttaagctataggataaaaggcaaaactgttttattagggaagactatgcttagacagtcttttagaatgattgaaagggtatatagatatgagaaccagtctgctattccaaataatctagttaggattaaaaataaaaattttgtccagatgctgtatgaaaatctactttatagtaggattataattattgctttgttttaataggggactcttagagacaaggaagaaaagagtagggaaacctatttgtataggaaaatatagtacatttccattcaatatctacctataatgtgagagattatgccagacgcattgaaattgctgtctttaatcttcatcccaatcttataaattagcttttgttaccactgtttccttgatgaggatgccaagtccacaccaaatgacttgcctgagatatgtattcattacattttggagttgagctttgaacccagctccgtctgtgttccatactcatttcttttccctgtatcagaagatccacccacactggccaactgagaagaaaaatagcagatgggcttaaatatgggtaaatgtatgataatgtacttagtgaagaaacacctaccaaactacttatagtttatagactcttaggtgttaattttaactcatgaaagaaacctgggagtcataggtttctttcttaaatatgggtaaatatatgataatgtacttagtgaagaaacacctaccaaactacttatagtttatagactcttaggtgttaattttaactcatgaaagaaacctgggagtataggctctctcagcatgattattgtctcttccctacagtcaattcaggagggtttattgaggacctactttgtgtgaggataaatatagtgttcttgtacttaaagaacttacatcttttccttccttctggccgggcgcagtggctcacgcctgtaatcccaacactttgggaggccaaggcgggcggatcacaagttcaggagatcgagaccatcctggctaacacggtgaaaccccatctctactaaaaatacaaaaaattagccgggcgaggtggcacacacctgtaatcccagctactcgggaggctgaggcaggggaatggcatgaacccaggaggtggaggttgcagtgagctgagatcatgccactgcactccagcctgggtgacagagtgagactctgtctaaacaaaaaaagaatttacatattttcccataagacatttcttatgttcccatagtgagaaaaataaccctgtaaaaacctctttaagcaatatctcaatctgtatggcaaggaagatagatgagtgtactcatgtatgatcgtgtactgatttggagtatgttttggaaatgaagactaaaactttcactttaaaataaggttacttttctctaaaggaggcattttctttgtagagtcattatgatattatttcatagctattaaaatttgctatcttgatgcttggttattcactgaaaggaatgaaatatttattaaggtcatattactgttgtgtacaaagggagccacagggtgacttttatgctatgcctttttggtagcggtgtttctgctgggttgcatcaatgtctgtagattttattgattataattaagtcagtctgcattgtctctgagaatttacatggctttaaaaatcaatctctcacatactcattttttgaaataatttgaaaaaggatctcagtagaagggacaaatctacaactattaatcctgttgttatttgtttgagccaaaaatggtgttatttctcattaaaacatttgcaggttttaggtgttatgatccttttagttttcttttaatttcattttctctaccaccaagctttcaaaggcattttacagcttatttttatctctggtagatttctgggtatgcctggcaaaacccctagctcaaatcctgaaggttatttaaattccagtgttggatgctctccacatatatagattttgatgtacacttaataagattaggaagattttatgccagttgataccttgcatgtacatgatggatcagataaaggaccatcagagggctagtgggtctgagctttgattgcaggtagtggggaacattgtcagagctttttttgtgttactttaggtatacatttttaagccaagtttagcacatatatttatgttaacttggggcattaataatcatataagcttgtggaattaacccatacagatatagaaaagcaaagccctaatcaatagtgcaaagaccagttgtgatttttaaaaaccactgcttctgtggaagtgcaagcattgacttatgtttacattatttttctaaagcaactgatttcagtgacacctacttctgcctaaattggctgtctctgcgtgtgcatgtatattaaaggtatatattgagagatatatttgaaaaagttatagtttttgaaataaaaaataccctagtaaattgcccttttatgatggggaatgattaaataaaacagcattatttataacattaactagaattaaatatacagctgggtgagactttgtttgtttggaatttcttaaaggaattagcttcagtttcctaaactagagatatgtgaagattatgaacaccaacatattcttatgaccttgatttttgaaggtgttcaatgaaaaattcttggattatattccttaaaattcaaaatatatttggaatactccaggactatttcatgcttgtaagatggaggttatgtatctcttttctaaggcttgaaaaattaagccctggctatagcaatcttggtgttgtctacaaacccacagctttggtcacagttttttgaaaacttaattatgaatggctgttaaatatttttcatttaccaacttatcagcatttccttttttgcagcaagacttacttcctttgcttatggaaggccctaagtttgtttagaaaacaaagtctgtcttatcataattttgttggtgagaagatgcagctatataaaacaaagaacaaacctgtgaaacttctgctcctcctatcaggctctgtttgtgggaagcctaaatgcataaaatagcaacttgttaaacttagccttgactctgtttaaggggatcttttatttgcaaaatttagtcaattcctccctaaaggaaaaaaagtcattttagtggatcttgaaagcttttagataaatattccaagttttttttcccctgctgctgcaagcttaaaaggcaacatagaaggtctgaagcctggtttttccagctgtgtaacaagcacagaagagaggattctaaatatttactcctttttccttcccactattctgtgttccagtcaaacttgatttcttgctgtttgtttccaggacacttctcaccctgcattctcttagtttgtccccccaaggaatgctcttctttccatcctcacatctctgtccagtagaatcctatttgtcattcaatctgcatttaaaatgctatcagctcttcctgaagactttatggacacccccaaccaaatgtggaaaggggtccacaatttccagtgcaattaccttacctactttttggctggactcagtactctcattctaccttgtgtgttaggtgttcgtgtactcagtaatgttcggtggtcaaccgatatttactaaatgccccttattgtcaaacactgtgttacttactggggaaagcgaacggtttaaaacatggcccatgatgtcagtaacctctttcttgttttttttctccccaacttggttctgaattcccagttggtagaaatggccttataattctttggtgttctctgtgaatcctggcttcttgcacatagtagctgctcaagaaatggtcattgagccatattagttgagtaaaccagttttcttctgattgaatttgaacagcaaagatttttagctttcttctttggtatttaaataaaagtaatgttatttgttctatttgccattatattgtgatttttggtggtacagaaaggaagatttttcccattacccctaccatgtagtcgttgggcatttgttgtttggaaggcatggtaaattagcacaggtcaggcagtcaattttattgagtacctgtaggcactgtgttggcctcctcatctggctatatagagctaccctggagatcctcatgcatagacaactgtctgactgcaacctctggacaccatcagctgtggctttcatcaagttcccaaaggcatccttgaccccagaggttaagtgaatgaatctcacacctgtctccctgaaagatttctaaaatgtcagtggcatttggacaggttcacagctgctctgatccacagcattttctagaacttccttttacctcgatgggggaggaggaatgcctgtgaacttgagctgaccttcaagacgctgtagggctcttgggcaaattatggacaagacctacattgttaggataggcccagaaatccagcttgctaataaatagccttgggaggtgctcacagtcgagtcatagcatttggcatttccctgtactctagcctgtgtaggatttctggatgcttaggactgtaaccaaacttgaactcttgcctgggaatatgccctcccccacacccccagacctttttttgccatctaaatgacaaagataactatcagtaacattttgaactttcctacaaaattgcattcttcgtggtgtatagtaggaagcatttctttaccttggaactttagaagagggtctgaactgagcaaaaattagtgtccctgcctttttaacggctggacacttatcacaaagctgtgccaacatcagtgatggtgcacccacaaaggtgtttggtcttgataagcttctaaagaagcagactttgttgttgttttaaacagtaatgaactgtttcagtttcataaaaaaaaaagagacattctttcttaaatagaaaagggcagaaagtttatagagaataatgtctaacttgctaatgcagtgtttgcctttgctctgtggcatgtgtgtgtgtgtgtgtttatgtaggcatgcctacacggctgcttgtgttaatacttagtataaagccttaaaatggataccagattggctatgtaaccttggaagatttatttacactctcagtttcttttattcccaatcttttatcaaatggtgtttattatattctctgaaaccattaaataaaaaggactgtggaaaaattctaaaatgctaaaattattccaggctaaaaaaagtattacaataggatgatgatgtttaacccatctacttgaaataaaaagccgagcaaatcgaaatgtgatatattttagaaggtatttcttagagaaaaaaatgtttaatgttccttctagactgccattattcattgtatttttattttaaacataattatgaaatattttgaaagtaatcaagtaaatgtggtgacatttttttctctggttgagccaagtgataataacagataactgttatctataatgcatactacgttgactcattaaagcctcatctttgttaaaacattgaatataggatttgagaagaggagaagtttccttatttaggaaaggtttttggtaggtctttcttgaagaaatggagaaaatggcctgctgatctaatctgaggacgaataagagaatcctcctccctgtggctatcattcctatggtgctatacctgtgtgggtgtggatgtgatggtgtgtgcctttgttgggggaaagagagcacagattgtcataaggttgtacccttaattctcatcttctgtacttataggaactgtgtgcttgcctagagacagcagcatttggtccttgaaaaacgggatttcctgtgcaccccttagaaatcctcaggggctgatacaaagagtaatttcaaagagtttaccttaagagctttgtcactgagtgcagagaaaggaatttctgtgatgattccaaacttagagtcagtgctaaggaagaatccatagagctccaaggacttcaacctcaggggagaaaagcagtaatttatggatctttctagaaattacggttgggttctttcccctctcaacccaggcttccttagtcacgtgactggaatttaattatcagtgccataaataatcttgtgaatggaagcagtgtatttggcagtgaatttctgcttcctaaagagaaaggaacctttagaagttatttgaaataattctgtattagccacgatcctggaggcaaatggtcacagaagcagaggatggtatccccagagaaaagtgggttttagatgagtcagataatgtggatatgtgctggtgacgaatgacatgaaggttggatgtattttttaaaatacaaatttaaagcaggctgtatttagaagtttatttataattggttttaggataaagccagcctgttgatgcataacagagttgatcttttggttccattagcacccttgaaatatttaacaagaagctgactttagcatctgagcccttccaaccactgttggagatgaggcagtccatgttggataattcttgttgtaaaacaagcagacacctcctttgtttttccatcttgccccaagccctgtgttctagactagggaaggtcagctctttttatagtcagaggtctgtatgcctttgaaaatatccattcccttacctgtcctcagccagtaacaatttatgtcctgaagatagcaaggagtgctgatttaatttattttacaaacagtgtcctttcatgggagagagcaggctggtaaaattgtttcaagaatcagaacatttttcttggttatttataacataactcgacaatctagctacacagggcttcattcatttgagaaagactattgaatccaaaaataataatcctttatatttgtacagtatttgcagttttataaggaactcttcacgttcattttctcatttgatttttctgacaactccattagggtagagagggcaggtattgttacctccaaattacagatgaggaacctgaaacctgagtgcttgtaagtcctacccagggtttcacagccactcagtgactgggactggagccccctagattttaccctagctcaaaagccagtgctctttccactattccgttttgatacccttggaaagttcactgcttatctaggaaagaaaaattggtagttcttgctgaggaacgtggaaatctgaaggagagacagatctgagagagtcacattggctagtaagtaaaacaggaaaagaccaagggtgtctagggacctggcctcctgccctggttcattcactgtgtgatcatgggcaagtcactgacttctccttgcttgagatttattttcttctcttttcttttcttttcttttttgacagtctcattctgttgcccacgcaggagtgcagtggcgtgatctcggctcactgcagcttccacctcctgggttcaagtgattctcctgcctcagcctcccgagtagctgggattacagacattgcaccactatgccctgctaatttttttgtattttaatagagataaggtttcaccatgttggccaggctagtctcgaactgctggcctcaagtgatccacctgcctcggcctcccaaagtgctgggattatagatgtgagccactgtgcctggccctaattcccctttatgttttctctcacctctctggccagggctctgaagatattcctgggagaatgagggtacatgccacagagggagccttgggtttacagtcagcatagccctgcccatttccagctgcgtaaccaggagaagtggtggcttttctcagcctcagtttattctgtacagctggggtgagggtggtacctaagagaattaagtgaggtaatggatgtagggtccttggcatagtgactggtactcaatatcctctaaataaatattattctgtgttagggaaaagtgaatagagataaatgctaagggtagaggtgacgagagaagtggatggagacaaggatggcttttggatttgactgttttctccactgtaagcactgtttgttatctttcagctttcattttgtctctcatcttttcccccttcagatgtgaggtgtcttgaaggaagagacatttagaaggtgagggcattatgcagatggagaggtcggcggctaaatgtggttactgaagccctgccttgggtctgttcccagccttccttgattttgaaacacatgcgctctcagcaggccagggtagtttgcaaagctgttgtggaggcttttcccaggcagtgttacctgctccgaaagctgcaagcgtgcctacacacacttcacaaagcagatggtttcttttgctttccatgtggtctaaaaatcaaatggacttttaatggaaaggttggggaattccacactcaattatgaatccagtgcagtgcaaggggcagagagatggtataccacaccttttagaagaatttgttactcctggtctcatctggcattggagtggggaggtgagaaagaggaagtaagtaaataaagctgctactctgtgctccaaaactactgagtagctgacatctgccatttgcattgaaaactgagaaagaggagtgtggttttgtttttgattccacaagatgatgtggaagggcaaattgttttggttctatgtgataaactttgagtacctcctgtgtgcctgatactatgatggatacatatgcctagggtaaaaggatgagaagacacagatcatgtctttgagacgtttagcttgagtcacatttgctgagactgaagttgggctttgcatttgaaaagctagcatttttggatgcacttttgatgggacccaacaagagatgatttgtttatttgggaagaatcctggcatgcagtgaggagcacctttgtagctagaacatgcttagattttggtattcttgaaaatgtggcctcctccccaatgccagtgtataggatttaaaaaaaaacaaaaaaacacatctcaaaccttggcatttattgaatattaacaggccaggcaccaaagcattattcagcattgacacttaaacttttctgtattgattattattattattattattattattttttgagacaggatctcactctcttgcccaggctggagtacagtgacataatcttggctcactacaacttgtgcctcccaggctcaagtgattctcttgcctcagtcttttgagtagctgggactacaagctcgcaccaccacacccatctaatttttgtattttttgtagagacgggctttcaccatgttggccaggctgagctcaaactcctggcctcaagggatccacctgccttggcttcccaaagtgctgggattagagtcatgagccacagcgcctggcccttatcatgattttgagtttatgaaaaatgttgtataactatagatgggaaaaactattattgaatgttgttgtcattttctaccattgtaattgttagggtagagtaccaaatggtatttagcaaggtaacaatgccatacctcctccaggtcctcaaaaaaggcagtattaaaaatgaacctacactataggaagccttattctagtaggccagtatttatgcagatgattgttacatttatttattgtcacatgtcatagtctgtgtaagtcagttatttcacaggtaagctacatcttcatgtggttgccttctgcaagtgtctctttccttcttaggtcacagctagctatatagtcagtcacttcctcacttgctcatgcaacaatttttttgacacctactctgtgccacaaactgtaatagtcatgccatcacgaagctcatagtccaggggagaaagaaaagcaaagacaatacagcttgatttgtgatagaattaatgcagagtgccccgggctatctttctgcacgagaccccatcaaagccaagttgcagaggatgagtgggaattgagaggcaaagggttggtgcaggatggagataggaagcatggcatgtgtaaagaaaagcagagaggttggggagaacagggtgtgttccagcagttgtgcctagttctgcccaggccgaagagcaaggcaggagtccgcttaggaaagcctgcagctaactgctgtgtcacctctagtggaaggcttcatggcagctggtgaaagtctcctagcagggccatacttatcttttaccgggtgataattctcccccaccctttttaatttttgccattttttttattataaatgctgtcattttaagttggggcgtaaacgtagtatgcaggaggcaggcatgaattaatgaatagtaaagtcctcttaaattgccttataaaactaagtcctaccaggttcccctttcatctcagcagatgttttacaggatagaaataaaatctattttggttttttagcgtaccagaagataaaacatctggctgagtggattttctcccctctgattgcttacttccacttaaagcttttttcatataaaatttattgatatttttaaaaattctttcttattataaatgagtaatattatcttaagtttagaaaatttggaaaaagaaaaactacatagatgaatactacagttaaccttaatcttactacttgaagaactactataaaatgatagatggatattctttaaaaatttttttttctatgcttgtatacattctttaatatgagcagaatcaaattgcaataaactgatttttaaaaaattcatttattcaagagatacttgggctgggcgcggtggctcatacctgtaatcccagcactttgggaggctgcggcgggcagatcacgaggtcaggagatcgagaccatcctggctaacacagtgaaaccccgtctctactaaaagtacaaaaaaaattagctgggcatggtggcgggcgcctgtagtcccagctactcggcaggctgaggcaggagaatagcgtgaacctgggaggcagagcttgcagtgagccaagatcgcaccactgcactccagcctgggcgacagagcgagactctgtctcaaccaaaaaaaaaaaagagagagatacttgttatgtttccgtgctttatcttcatttttgcttggtaaaacctttcaaatgccctacagggaaatctggcaattgttgggaatatcaaacataggaaagtagaagtaactgtatttccctccttcccacatttgggtctctctatttatgaaaaaacgcaaaagaagcttatccggagatagttcaaagattgctttaaatgtgtcaagttatttcaatctcctatgccttctgtacacatcttcaacaggatttggtgaattcacagtgagagtcataataataatcgtgattttgaaaagtaatagttgtctaacactttcccatttatctagtgatgctatatgcattatcacatttaatgcttaaaacttgagctattgttatccctattctaacaagataatcaaagcatggagaaattaactctgtcttgctaagatcctcagatatgttctgaatcataaaaggttatgttatatttagcacagtgtttatagtaagaatgttttctctattgtgtgtgtgtgtgtgtgtgtgtgtgtgtgtgttggaataccattataatctataagtctctcttgattttcagctagtgtgactcccctttccataactcccacctcaaatttgaaccatcctgaatagagaggagctttaataaaccaactctattattggttctgtaagaccttgacatttgcaaactttattttttgccttttctcccacacagtagccactcttgcaaatcaaccttgggaagttagcattcttaatgaagatctataggagactttatccttagacagtaaatcagctctttcaaggcaccattcatctcccttcgagcgcatgaattggtatatggcaccttacaagagctcatttatcttatgtgggtccctagttattacttttgcccacttcccctagatcgccagagatcaaggcagaaatgaagtagaggatggctttgcactttgaaaatttgccaaggtcagctgaggtacctgtggcattgacttagagctggtgttgagtattacccataacttttagggtgatatcacccacactggcaaataattagtttagtttgtcaaagcatttgaattgtgcttggttaaataaaaatggctagaaggtaaagtaataggggaaaaagtttgttaccttgagaatttttttcctctttaacatttgtccaaatcatattgacatacttttggcttccatattagtgataaggatgaatttttactaagtgcctaggctatatgctaggtgcttttccaaatgccttaaaaaacaattctaccacgatataggagccattatcctcctttcatataggaggagctgatcatcactgatgttaaataacttgctgaaggatatgtgtaaccagataggtggaatcaggattcaatccgtgtatctccagtgtttgcccctgtgactgtggtaaggctgcagccttattggaagtcatccacttgtttaaaaggatgatgcatactctgtgcataatgtttgataacgaattaattgaagtggaatagcatgagcttacagtttgcagtggaccccgaagccaggctttcattgctaaaggagctaatacttgtttctgtggtttgggtttcctcacaagcagactctgaaacaaggttttgagtgcaagtattatagtttatttgggaggtgatcccaggaagtatggtgagggcatatactcaataacggatgccctaatgagcagattatcactgtgagagattgggctccctgcctgtgggcacctccctgacagactgtagaacatgcctcattgtttaactgagaagcaactccttgtctttcactagttgagagttgctcctgagtgcattaagtcccctgccctttcagcctgccccactttgccatgtggacagagaaagccctgaggcagagagactacggtgtttgtgcttcaagttggacagcatgtctgccccagctccaggtgacctccacggagtgtgagcagcatgtggggaggacaccaatagtttctgttacatttgcttttgaagccagcatcagtgctgataaagatgcatccagactgatgcacctggctttgggggtgacaaccttgtataaacaagtgagacaggagaggaggcagtgaagctaggattcctcttaagagaagaaggtaggatttggaatcaggcagtctggggtattgttcctagttctgtacttactagctgtatgctgggcaagtcaatttgttcgagtctcagttttctcagctataaagtggacatagctgcctcacagggatcaaatgcaatgccattcgtaaaagcgtttgtaaatgataaagcgacatgccacctttgagtcattgccattggagctcctgattgaggaatctggtggagtactaggtgctagcagagctttgagggcagctgtttgctttacaagacacacctgaaggctgctatcttggctcaagaagcctgtcctcaaatatcctgacgctttgaaagtcaagggtaagggattcaaaccctatgtaggcccctttctctcatctggtttctggcctactgagagttgctaaccctgctttgcaccaggtgagactgtatttccaatagccccctatcgagtgcagagatgttttggggggtgaaagttgattttgattggatttacaaccccatatatcaagcactagactaaaggtccatcagcctttagaagaagccacagtggttttcatttctttcactctgtttatcttctgaccaaaggctgactcttccacaggcggctgatatcgagtcaatcaggactctttatgcattatgtgaatttggccctcacacagctgagaatggcctgaatagctaagagagcatcctctctgcagcacctcttgactcctcaggacgagtcacactgaaagaggcaggtggatgcccctgattgtgtcccctcccatccagcatcatggccagcactgccattccttcaccccacccaccccagttagcccctggcttgaactccgtcactcaagagggaacattaaaaaccccacacctctgactcatactttgattttgtggcctaaagaggcaaagacgccgtaaggagcttttaggggccatcactatggagcctctttattgcccagcaaaagccttaaatgataatgggaaacctcactattgattggctgactcttaattcttcctctttgggttttgaagtagaagtgatggtccagaatatttatattactcattggatatattaaattaaacatacaaaagtcctacagccatttaagatggggttgcagcactggtgaatacgactttattaccaagagagaagagtagcttttagttgtggcttagctggaatatattgatgataagaatggctcagcagacagaagtcttgggactctcaaaaaggctccaagtgtgctttcttttaaaaaagttatttaggcccatcctttataaacacccaagtagatggtctgatggggtcatggtaacaaagattcagcttctatctaggtggatggtaagacccgctaacatcttggcaaaccgtgttattgggccattaaggaccagtgcttgaattctggggctgaaaattcaacgtattcccttataagaaaatgtctgctcatgataagaagtcacacaaagtacaacctcactatagtacaggatttagaatctttatttctccatctcatcttaaacccattggaagttagcatggattagagggtcggttgactcttctcaatgacggggctggcatataagagctaaaatttttattattgagttactactcaaggttttaaaagattttgacccctggaaaaaaatacagtgcttgaggcagtgaaatagttaatatgactgcctcccttacaggtttccccagatatgcttacttgctgtacaatggataattgttagctcttgttgtgcagatgctgttgcagatggagtcctgtacctgcatgcatagcaaatgaattagactggcaatcccctttataaagcataaatatgtaatttgttcagctgttgtaattaaatatgtatgtgtgaaacagccaccattcaggtcattaatgatgcgccatgccaaattagagcttacagacagtaatgtacattgttgtgcaatgagggaattgcaaataacatggctaagcctttcctagtaaagggatgcattcagcagctttaaaaagaatatttacatttgtaacataatttttatttagaaggtacatttttgttcattgtgaaagtctgtaagatggaattactttcatctccactttagttttattattgttttaacattttatcatacaaatgcaacagactttattaaacatgctgcttggtgataagtgttaagtatctacttacatataaaacagcagttacccctggttttctacatggctgtgatagaactgatgtatcatagcactgtggaatgtcttgataatttcattgcattaaaaaaaccacctcataatatttcaactctattccctactgatacataaagaaattcctgtgatagtaaatagtatttttatttccatagaaattgggctgagaaaaatgcagttatcaaaatataaacaaataaaagtggtaaatgtgcctcttgtgctttaattcccaatgaattacttgtgaatccaaggaatttcctaagaaaagtgtcatatatgggtcagaatggttgctttttaaaatttaagactcaaagtttgttaagtgaatgcacttgggaaaattattgctttgtcctttttctccttggttttaggttacagtctttgaaaatacttgaagctgaaatttaaatatataaaaactatttttactttaaattctttctgtatttgtattttggttgcctgcagtctatttttaacatacatgttgttttgacggttcatactgtgactacatgagctaaccatcttgacctttctgtccaccagggcagcaggaggaagcatcttagagttaattctgtcttgttcacagctgggaacagaacattcctctgtgatccccttgcacatgattcactgggatctcttggaagctggacttgatactataagtcctaggcttctaaggtcgaacacagatcaaacttagtggcatgtttggttaagagttagattagacaaaaccaatgaagttgttaaaagtttcagaaacaattgaaaatgaaattgatgcatgattttagctttgcaacaaattcaactttagaaatatccttaagcctaagattaatcaagattcaggaccttgaagaattttcaaagttagaactgtaatttgtgtagggacgtaaaatctttattttcaacaaacagcaaatgtttccgttaaacaaatgtgtattttatttgaaacagatgaaatcataacagtttggcttgctttacctaagttattgttccataatatcaaaaaaattacttaaaataagttcttctcttcatattccccgaagtttttgtccagttttctgtatagctttttggttcagccaaaaagagacatttcatttgcagcattagggaaaagtttaattattgtttatgaagatagaaatgttatatgaatgacagtgatttaaaaatattattacttatgattgtagtcaaccttttccccgaatattgaaaaccatgaaaaggctttgccctgacagctacatgcttagcattaactatacttgcaagttttccaaaaagatttttttcaagacctgttttcatttacttcctttatcctaattagagatcgtaatcttttgatgggcagcttctcttatttctacctgtttcagtactatagtactggtaaaatggcacagtgtatattttggttcttggagggagacttgggaggatccattactttaaaatattttgttgcagccacctatcagaggtttcttttaatttcttttactgcaggaatttcagagatgcttaaattatagaattatggactacagaattatagaatacctagggatgggaattgggaggtttgtaggaggcgtgcacgtcagaaggtgggagccatgcagaaaggtcacaggtcttatctaggtagtttcaaggagcaaatgcttgttttgcagtagtggtggcagggtggtttggctcattcaagccccttgctctggaggaacaccgataaaccatcaggatgtcttttcgtcttgcgttaactgtggcaaggctgtgcattaaagaacataaccatcactaaaagggtgggaacaccccagcgaccagtggccagtggccaggtgctttatggtaacaccacagacatgcctggccaatcagatgtgatcttttgctggcacttgctcctttggcccccactgcagtaaacactttcccttggatgttggttttctgttgtgtctggcagccacacagggctgcttgaactttagccagaggcaaatatttatacatcagagtgtgcagtgttcaactggtcaggcctgagagggagagggagagacctccgtgccttttagccaaagaggatatgtcctttttttccccttccctttccaccgtgacatggtaaagtgggaccatactggatgtcatttgagcttgctgcatgtgcttctctccaaaacgtacacgtgcgcaaacttgggatgtgctttcaaaagagaggacgtcctgacatttctgcctgctcctttaattcctcttggaaagtttacggttaatattttccctggaacattgtcaagcttttgacagtgcctgagtgtatgccgaactgtgaaattgagccggagaagcaagttgtgagaaatctgtttctactcagatccgtaaggtttatgggggggggaaaaaaaaccaaaaaaaaaaaaaaaaacccaaaaaaacaaaacaaaacaaaaaacaaaaaacttcagaggggaaactgagaatgggactcggcttgcttctcctggtgtgggttcaggccgccattttaaggagccagtgaagggcgacgttccgctccttacatggcggctgtatttactcggccgcagccaatcagccggcagtgccaagccacgtgacatgccacgagggcacgcacagccatttccttgtttctaaaaaacttgctacctccacagagtactttaccttgttttgcatgccaaatgttcttgctgaatgtgtctagcagactggcatttgtccataaagttattttagtaggtaaaaagtctctgagcacttgagctttgtgcattctttatgtaaaatggatttcccttcttggccagaggccaagggtacagcacactcgctgggtgagaagagagcttctctgctgagaaactggtggaccgacacactctaattttttggcttctgaccaaacaagctagaaggatgccaaaattcaacaaaataacacattattgtgtgataggagccgtgctccaagagagcaggaactcagaggaacttcatactggccccttttaaaaaagcattgtcactttggggagctttcttagagaaacgagaggaaaatggtaaaatgcaacctggagagtaaggtataatttgcacatgaacacgaaggaaggaactgaaagaaaacagaggagtttaaagttacttctatgaacttttcccagacataacacacagttctctgacttgacttacattcttttaaccctgaaagttccatctctgtgtctgagcagaatgctggactgcttaacgttaatatgagaactaatgtgagatttaaacacttttaaaaggttttaatgtctaaggatagctgcaaattccaaatatgaaaatttggcaggcttttggggggtaacagaaaactttttaaacttacatgctttatctttgcaccctgacatgtgttaagtgagtcaaatcttcctgttaattactcttgtgacattagcaagttatgtaagcccactatacctgtttccacatatgtataatgaagacgttaaagaagataggtagtagtcttctgagccctaaagaaattgaatttgaataaacaactggaataagtataaaatgcatttctagtttttatgtggaaatttgtcaatcaaaaggaaaaaaaggggaatatctccagttgaagccaccatcatccttacccagactacttgggtaatcctgagtattccctctttttccattcttgttccttcacaccatagccagagtggtatttcaaagaagttagttagtttatatcactcttctgcgtaagaacctccaatgttttcttatgcatctagaataaaatccaaacttgttgcattggcctgcaaagacactgcatgatctgtctggcttctgtatctacctttctaaccccactttttttttttttttttttttaaccgtgactccttagatgctccagccatactggtttcctttcagttttcagaacctgccatcccatttgctacttgtctgcttagaatgcatttttcccagctccttttgtggctggcttattcttacctttcagttctttcagttcgaataatagccctgtaaaagagtgttctgtctaaaattgtccttcctgtttatattttccataatactaataacagtctgaaatgctcttgttaatttatttgattactcattttatttatttatcttttgcactatgatgtcagtcccacaaggatgcaaactacgtttactaccttcttttctaccttttgcacttttcctaatcacattgggaataaaatgttgggcaagttagaatactccaaaatatttcatttaccttaaattttactcaatcctacattttattacctatactcataagaattgtattataaaatacattgttaaacgaatgttttcagtgctccattgagagtcggtggagcacactggttgggagaagacagagctgtgagccatccgtctgcctgtgcttgagtcttggctctgccattgactagttgtatgaactgccgcaggtggttcagccactcagaacctctgtaaaagtgagatgtaaaaacactttctacatcataggattattgtgaagattaaatgtgatatgttgtaaaattctggtcacacaagtattaacttactgttatttttgctgccactgctattaattaatggcagtgtggcggctcagtactaggcaatgggcgtgcaactgtgatgagaaacgcttctgtccattaaatcgttcagtcagtggaagagacatgtatgtaaataggtaagttacctaccatacattgtgccaagacctctcacattatgtgaacagaatattaaagaattataaaagagggagcaattgcctctgttaagtagacagcaaagatgccttataggaagtagcatttgagacagattaagtttctttttaggtaaaaatatgtcccctagagataataataaaataatagcaacggatacctatgtacttcttttactaatgcaccagagtctgttttacatatattctctcatttaatccttacagcaaccttatgaaacagtactgttatcaccttgattttacagagaaggaaagtgagccaaagagaggttatgtggcatgcccaaggtcatataactattaaatgtcagtgctgggatctcgtacattttcactcttaggacatctgtgctatccctgcttagtcactttggcatcccagtggtgctgtacttttgctttcataatacatggaagccctggaaggattcagtaaagagccagtttcaccctgttagcccttgttgctttatttgtaaaatgtcaactgtaaaagtatgcacctaccttatagggtgattatgagaattaaatgagataattcaggtaaagtgcttagcatattgcttggcatatggtaagcatttaacaaatgttccccgtaactactactacgactgctattattattattatgccatattgaaatgagatctgtgatcccttgtgacctgcccgagccccccttctcatgttagcatccatgctggtatatccacttccaaagagaacaagttcccagcagttgaaatggcatcctacccaggttgctagcaccatccctcagctgcttctccaactgccataactgccttagtcatttaaaaattactcttctcgttttatatttcaactcagaaatcgatgcatctgtgaggcagtttgttttcctggggaagtgtaaggagcggtggtggtggcatggagatgcgctccgtttagactcaatattgccacccactccctctgcagtgtcagagaacagtctcagaaagatctgttcctttctttctagactcagtaccacagactggcctatcctctgcaactttgcttagcagcaggagtagagaagtattgattgcccacaacttgcctttaagtcttgtttctgtggtgcaggatttttaaaaagcatttaatgttttccctgccttgaagacttcagaaccgtataaatgccactgtttaaagtcctgtccctgctgaaaaccagggcaggtctcatcacagccccatctccattttccttttgttgaagtgggtctgtgtgagagcgggctgtgccctccttctccacagggtggggaaaaggcagccctgtagtaaggaggttgaatagcctcgctcactttgcctcctgcttgaggtggactccgtgttcccagagatgttgggcctggtttagccagttgttaaactgaagcagggttagcttacccttgaagtgtttttgtttgtttgtttttgttgagacagagtctcgctctgtcacccaggctggagtgtagtggtgcgatctcggctcactgcaccctccgcctcccgggttcaagtgattctcctgcctcagccccggagtaactgggaccacaggtgcgcgcccccacgccagctaatttttgtatttttggtagagatgggatttcgctgtgttggccagcctggtagttttcttacatgaccatctttagatttcagagaaggaagaacatgatcccagaaagcacacagagttacaacatagcaatagcccctccgagctcaacaaaaacatctattgtgtcatgggctgcaaagaaagaggtatgctgggaaccaataacaagatgctaggaatttttttttctgttctattttagcttgaaaaacttgttttccccatatgagttgtgcatttactcttggatcttaaaagaggacaatttattaatctgggtttaaatcctggcccagccacttggatgctgtttgattttaggcaaattatttgactttgtgctattgtgtcgtcatcgacatcatcatcatcgtcatcttttagctgaattctgtgactcttctagggcatttatggtagacagaaatctgttcttgtaatgtagaaatcagtcatttagtgtatctgaaaattcccatcttcaaaaactagggccagatttagtcattcttttactcttaactgttgctaccaggtcatacctaatttgtatttttccaagttacgtatattaaagtcatactaattggtgcctgagcaagttttcagattcctgtttgtccgattccatctgggtcaaattacttaggtacaataagtgcttccttgtctgtaaaataaggatagtagtatccatttaataggcttactgtgaaaatgacacatgatttatataaaaaatggccagtatggtgtctcttaaaaattgtggggcattatgaccagtcaggcaaataagggaccaaggagataactgtaatcaaatcaaagtcctggtatcaggaggtatagtagggtaacgggtcaaggaaaggcatggtcttctgtggcccagagaaagcagtggtcttggcaggtcgtgggctggcaaggtatggaggagacagattcagaagctaagcagacaaggacaaggagccctgaagattagagtgtggagctggggcctgaccttagggcagtgactcttgcccttctgcttctgttctgctctgcttggattgcatatggcttcaggccctggagttacaggtttggagagagtgctctagagtgtggttaaaagtcattggctgggtgcagtggctcacgcctgtaatcccagcactttgggaggccgaggtgggctgatcatgaggtcaggagatcgagactatcctggccaacatggtgaaaccccctctctactaaaatacaaaaaattagctgggcatggtggcgcgcagctgtagtcccagctactcgggaggctgaggcaggggaattgcttgaaactgggaggcggaagttgcagtgagccgagatcgggccactgcactccagcctgggcgacagagcaagactccatctcaaaaaataaaaataaaaaaggctgccataggttgcgtctccagctttcaagtcagtagatctatatcagtaagttcactgctagtgttttactatgcagactcagtttgcctatattaaaaagacttcctgtcttcttacatccgaggagactggctaagcaggagggctaggcgtgttgaatcctagaaactcactgaatacttactgatgaatggactgggtctgggtcacatcttggatctggggaactttagttcacatttacagtcttaggataaggaataatgtcacgtattgcttgttcttcttaccgtgctgtttgattttaataatgatatttagtgaatttaatgaaattaaatgtgatattaaagaataatgatattttaatagcattggttgagtgctgcaatgtggcacacaggtagcgttggaagcctctccatcagttacctcatttaatcctcacactacctctttagagaggtggtactatttccccccatgttttactgaccaggaaattggcaccaggcaggtgacactagaggccacggtcttaatgaccacacaacatggtcttcatcagaatagattccatctccatgatgctttgcactaattaattctttccgcagcagcaccatgaggttggcggttcctttatttgccagctgtttattatttctgtgctaccaacattatgccaggcatggattggagtgtggaatcattcctggaagccaggccatgttcctgagttgtgctgctgtaagaattgggatttaaagttccaaatgtgtggcttccagtattttccttctaaaacagacacacgtcttatcccatttttatggttacatcacaagaatgattcacatttaatcaaacaagtcaggcagaatgatagctaatctatctcagggtttgttgcaaatgttatttacacatattgtgatatacctgattgtgtctaggcatccactgaaacaaacaaacaaattttatgacctgtagttacacagtttctaattagaatatgtgggaaatcagggtccaggaatatgagttgaataacatacattcactctagaccatatttggttaccctggtacttaaaatcttagtcacatgatttagacttcttgcaacaccaacttcttttcttcctttctccatggcagtctttgtatcatttttttctgctgagcaccaaactcttctggcagtttttaaattgaggtttgtagttttaatggtctggtactataaaaagccaactttgtgccaaaatttttccaagaccagacatgggttttgacaccacaataaattaaagataaataaagaaactggcagtgaaaatgaaggatttttttttttttcaagcaagcaagggtagcctatttgtaaatttcaggcatgttttcttagtactttagctcaatgttacaatgcttagctacattaatctgttactgggtaactccagaaagaatgttagaccaaaccattaagagattggcgatttttttcccccttgagcattattgaaatttgacaacattctcatagtctctgctttcttttaaggatttggctatcaaaaatacgggtaagtaaaaggaaccaagagaaactaatgaccaaatgaatagtagtatttaaagtctcaagttgctatgatacaggcttcaccgtgacctgagtggataaatgctaaacgggatttgctttccggagaatctgggtgcctgttccaccaattctgtttgtctctagcctggtttttttttgcctcctccctttcccagcaccatttattttgggttctgagaaacagcttcctcccattacaggcaccaattcaattaggcaggagatagtgctgaaggtttttgtttccatcagcttctgctgtgtagatagtagctctgtttgaaaaactttgagaagttgttgtgatgtgcctctttctgggttccgatcccttctcagcctggtgatgccatggcattcaaatcaatttgtttctcttcccctcccctaccctacatccatcatacaaaatgggggtggttgcactaatcagagatctgcttttttccccccacagatattggtaaattattaaaaaaccataaattttcttctagatgctaagtaactcttaacagtcttctgagtacgtgagtttgggatttggccttgcccttacagagacctgttaacttttcaaacccgtgacttaaaatttactaaaaataacaagttttgttgttgttgttgttttgttttttgtttttttttgacatggagtcttgctctggtgcccaggctggattgcagtggtgcagtctcagctcactgcaacctccacctcccgggttcaggcagttctcctcctcagcctcccgagtagctgggactacaggtgcgtgacaccacacctggctaattttttgtatttctagtagacatgggatttcaccgtgttagccaggatggtttcgatctcctgaccttgtaatccgcccgccttggcctcccaaaattacaggtgtgagccacagtgcaaagtgttgggattataggcatgagccactgcacccggccaaaaaataacaagttttgaagcatattagaaataatccaacaaaaaatttatttttctttagtcttctaaattagcaagttttaggccaccatgtggaactgaacctttttggaggtttaaaatgtcaaaataccttgccaggcgcagtggctcatgcctgtaatcacagcactttgggaggccatggtgggcagatgacaagttcaggagtttgagaccagcctgaccaacatggtgaaaccccatgactactaaaaatacaaaaaaaattagctgagcgtggtggtgggcgcctgtaatcccagctactcaggagacagaggcaggagaatcccctgaactggggaggcggaggttgcagtgagccgagatcgtgccattgcactccagcctgggtgacggagcgagactcttgtctcaaaaaaaaaaagaaaaaaaaagaaatgtcaaagtaaggaaggagttgtgtgtattttcagtcttgacttcatttactgtaagtgccgaagcaccaagtgggaggtggtttgggaagtatttctgatctaaagaggaaactccataaatcacccatggtaatgtgtctcattagcaacactccaagtagatgaccaacattccgaggagatgttgctcattttcatcctgcatcttggcctttgtgcttacctggccctagcttagattttaaaatttaaacatttttgtttctcactcttgaaaactttggtactcagattcttaaactcctctgttaaatagttttcagattagcctagtatagcgttcaaaactggaaaccactgccagaatcctctaatgtgggggaaaacatggctattatcattgaatgtgcctccaaaacctatcaaagttggcagatgtccatgtgtttggcttggaccaatttataaaacgttcacatgcttatgaaaattgttatctctgctattcagaatagttgagtataaaattgagcagaaaagcataataagagaagaagctctgctatgacttgcagtatttttcttttgatcactgaatactacaagaaggatcttttgtttgcgtgtttgtttcaaacttttccatgtatagaggtgtcttaggtgaagtgacaactaatgacatgtggaagtcactctctctggtgttctgtttcttctataactaccctcccttcctgtctaaagagagagggaatagctcctgaattaggtgaaacaaatagtttttaatgtatggtaaaaataagtcattcttcctctgttggcaaaattcattgtaggtgcctttcagtgtagttctgcaaatgttttttccattagttggagtagaaaagagatgaaggattatcagttgtcaggtatattttgcttctaccaaagatgatacataaatatgaaatatttgcagaacaagctgcaaaaccactaggtcctagaaataaaattctgatggttaatgcatttactttataatatgaccactttttccttttaacattttccccagtatgtccttagtgcctttcctggaaataccaaaaggcaaacatcccactttaatagaagtgataattgtagtacacattcttaagagaatgcctccttatgcctacatttttattgagggctttgtctacatacatccagagtcaacttaacttttggacccaattaactgattggcctgatgaatttaattaaaataggggaagtgcttgtacagagaggaacagcattagtataatgtggtggttaagattaacaagattgatttgacttgataattaattaatttgattaacaagataatttagtgtcaggcggagacctaggttcaaatccttactatagatgaccttggttttaaactctttaagtctcattttttccccatccattaagatgtcataaaaacactgaccccagaaggtagtgagaactggggagataagttagggaagtgctcagcacaacacttgggccagtcactgatggacggtagtaccttttgttattttctagtatttttaaagtatgtgttgtctgaaagacaccatgtctcagatcgctgtcagatttctttgagtgaacagagtcacttctttttctgaagacatcagtagtgcaagcatcatgtctttgccttgtattttgttcatctttttgcagttggaacgtttctccttcccttatttatatcaactttaggtcgtgttaactgtccctatattttaaaaaataacattttataatttccatgcaaacttaattaattttcacaaaacccctgtaaggtaggcaaggtagatattaggttatagagataaagaattgtaaaactggaaagaaatatggccttgacttcaccctatcattttgctggtaaagaagcaccatgttcaaggtcctgtatgtaggaactggcaaagataacaaagtagatctgaactcagtgcccttcccactatcccatgctgatcacttttctttttaattaaactgccctgttcctggccttccattgacaggttgcttacagctcttaatttctagggttctcaaaactgtttaatgagtgtgtctggattaaatccagatactctgactatatagagctcttttcattttcaaagatatctaagtaaacacagcatagaattcttcacaagttcctatcaatttccccttttgaaaattatggctcttttctgtagctttctgagacatcaattctgtgaacctttgcttctttctctcaccacctcttgttgtatgttattctgacttcaactgccacattttaagtcatggtaaccaggaatctatactgaaatattttcattaattcttatttattcggcagcatgaacagttgcagggattcttggtgtacatttgtaagttttcctttcctgttgtattttatggaatgttaattttgctcaattgggattcctttgtcaaaactgctgtgatgacagggtcttacggcatcatgaatgtgttcccctattaattaatattatcttagccatataagaaaatgacaggcacatgcagcttgtaagtgaaatgcaacccaaggagccggaagtctttcacctaaaccttaattttgttcaatcgtttgtatttcaaggtctagtctgtaatttattcccataaacaatgttgttctcctgacctttcttgtgtaccctcctctgtctgtatattatcattttccttatttttgtctatattgtgtcactaagagttaagacattttaaaatgtaatttggctacctcatccattttatctgcatttaaattgtgtttgaaaattttacttttgcagatttataaatttttttatccccttacagttttagcctattcaaaggggatacttattttttgtaaatgttttataataaatttaccattttgtgaaaaacagtgaaaatttacatactttttagaaccacaagaaatatctcttttaaaagctactttttaataatgtcattttggaggctagaaattcaatttcactttttattaacttagttcttgtgtgagaaagaaatgtgacgtataaagaaagcagagtaaaatactataaccgttttaaatcagtctggattttcttacagagtaactgaatttttctgtaccatagatttgatctttttagtcagactttgctttatttctctacagatgaattcagaatccactaatgttgtttgcaaagtatattttaaactctgtaattaacatgtttacaagtttttaattttacaaagaaaattaaaagtcagtttgctttgtaggtatgtttgttcttgtcttatgtgtaggtgctttatatgtgttttaaacagagtttaatggtatcttctgagaaaattatagctttagtgtgctactgaaaacctcaagtagggaatcaatacctaaaatttgatttggataagaaatttgtataaactttataaaggatttttgcagggcaaaaatttgcatcctcatgcccaatattctgccttacttagtaaattcctaggtcatggctatggagctcctaattaagttaaagaaatcttcacttgaaccagctaaaagctggtttaagataaatttggaaaatgtctagaattgataatatattttcttttagttttctctgctactcttaagggtacatgtaaatacatttcttagcgtagagcaaatgttgcatgcaatatgactggccagtggcattttatttcaaagatctcatgctaatatataggagactatatattatttttttttgtatcagcatgtttaatttttttaaggttaactgtgtgcaaatgcatatttgctgtccaaactagttaatgggcttacaactgaagggtgtaaattctagtatctgtattctccagcttgaagcagtgttgtctgaagcctgaaacggctgatgttaatcttcagcttattttgttgatatccaaaaattaacttgaagtagaataaaatgtgatgtaaatcgacttctctgcatactcataacagtgtcaatagttaaaaaataaagtctatataggtcacactgtttaaaaccttaaaggagtgtgtgtgtgtgtgtgtgtgtgtgtgtgtgtgtgtgtgtgtgcgcgcgcgcgctgtgtgtgtgtgatgcatatgtatttgtgtttaattaaacagagggaattgctggcttttaatcaagttgatgaattttgaatttccacttcagtgatggctctaccttaaattcatttggctgatgtgatagcagtattcggaatgcaacgaagagataagagtttggaccccatatttataatattccagaagaatttcattatgtaatggctagaaactcagatttcccacagagttgtagagtgtgcagtttggcatgcttatttactactctggttcttttttttttttttttttttttgagacggagtctctctgtgtcacgcaggctggtgtgcagtggcgtgatctcggctcactgcaacctttgcctcctgggttcaagcgattcttctgcctcagcctcctgagtagctgggattacaggcgcctgccaccacatccagcttatttttctatttttagtagagatgggatttcactgagttggccaggctggtttcgaactcctgaccttgcgatccacttacctctgcctcccaaagtgctgggattacaagcgtgagccaccgcacccggccactactctggttcttaatagtgaaagatttatacctcaaaaacactctgtagataaagaaggattcaaatatgattctcttaatattgcatggtttggctaagaaaccttgttattattcaagttactgtgagtcaagggcttgcttagaaacagcagacgtaggcatggcgcggtggctcatgcctgtaatcccagcactttgggaggctgaggcaggcagatcaccaggtcaggagttcaagaccagcctagccaatatagtgaaaccccatctctactaaaaatacaaaaaattagccgggcttggtggtgggtgccagtaattccagctactcgggaggctgaggcaggagaatcgcttgaacccgagaggcggaggttgcagtgagccaagatcgtgccattgcactccagcctgggtgacaagaatgaaactatgcaagaaagaaagaaagagagaaagaagaaagaaagaaagagaaagaacgaacagacatagatagtctattcccacttcaagtagagtaaacaggcaaagtggggcaaggaagagcggatgaaaaagccacaaggcaattcattaacccattttaagacattttcaggcaacttgtgaagcttcaaaggtcaaactgaccaacatttaattcatcacagaaaaaaaattctgggagaagaaaaaagaaaacttgaccttcacggtttaacaagttttcttaaaatgtctttatacaatcttgatagagttctttgctaacatgattcatcttccaatctatgcaaatcagacttttaaatcatacttggttttatataagggcttccttctgattgactttggagcaggtaacacagagctcttgatggcagtgccttgctgtgtgttctgttatggtgacagagagagcaccccctgcaagggtgatttagtgtgaaagtactagggtctttgactgagaagtcaccaaaaatcaatggctgtattgttttgaatgttatctgggcttgcaactgagaataggacctgggggttttactctttttattccttttcattcgttcttcactctctatctgaattgcagtcgtggtcctctggcaggcagcgtctgtatgcgaccggaaggcagtgctgaatagtggggtgatgttggcagagcactttccaggcatgctagcacctagcgcacaagcagagaactttgcttctgccaactgtgacttcagaacccaggtctgttcctgaacctggatgcccagctgtcagtgtgtcgccatatgtcaccagcacatggcaccctaattaaaatttcaaattgcatgcatttgtgtttgctggctggcttgcttaaaaggcagagacctcaccaccccggcttgcccccctccttcatcactctgaagtattatgtttgccatccttaggaatgagttggaaaacggcctttgcccactaaaaaatcatcactctccaattctctcacctcccattttgaaataggaatagtccttattttaagggagaaggagtggtgtgaagaaacgtggctggtacccttcagtagaattctaaagaccagaaatgtggttctcgtgtttccagtggttcatacagatcactcttcaatgctgtcctctctttgtgaatatgtttagctctttttatgtttacatttgaaattttaaaataggattagatggagcattcttggaaaacagtaacaacaaaatttaatgaagtaggtcccttcgtgcaaagcaaaaaagacatactgctggttgaggatatctgttaatagctaccatttattgatcatttacaaaatgctaaggaaaaatgcaagtcgatttacctgtgttgcctcatttgattctcacaccacttctattctgtggcaactgctaacactctcattttagagatgagcataccatggcttatgtagcatttccaatcttatgtaccgtatctcgtgagtagtagacatgaaatttgaactcagatccgtttgacttgagattgtatatactacattgcttccttcctgggaagaaaatggaagttttttctggttccttctaatcgtagcttcatagatatgtggtgtgcttccaagtgtgtatacttttccatgtatgctaagttttggtgatgtattaaaaaaaggttgaatggccaagtacagtggctcatgcctgcaatcccagcactttgggaggccgaggtaggtgggtcacttgaggtcaggagttcgagaccagcctgggcaacacggtgaaatcccatctctactaaaaatacaaaaattagccgggcgtggttgtgcgtgcctgtaatcgcagctactctggaggctgaggcaggagaatcacttgaaaccaggaggcggaggctgcagttagctgaaattgcatcactgcactccagcctgcacgacagagcgagactccaactcacaaaatatatatatgtatatatatatatatatatatatatatatatatatatatatatatatatatatatatgtatgtatgttgagctagaattatgcaattccctattgacccttagtcaccatttgcagtgatgacaaactggggtattttaaatgacagcaggaggcagtgcagtcattagcagcatggactctggagcccagttgctgctttagatctcagctcccctttgactagcgtcatgatcttgtgcaaatcacttgaccgctcagtgcctcagtttcctcatctgtatgggataataatattatgagttaatccatgtaaaacacttagaatcttcctcctggactattgaaagtacccattagaggttagctaaaattaatcaacacatttttagacttcacacagaaaaaaaaagaaattaaggaagattaattgatccattctttagaaaattctgatactaaacactggcctttatatagcatctgattaattaaaatgagtcaccctcttgatttgatctgccagtcaacaattgctgatggagcttctgctataaaatgatgtatacattctccaaaataaaaaacagtatcataaaccttaaaaaggtaccagtcatgttgggtagacaagacatatctacttaggttccacaagtgctctagagttgtttacctattcagtccagtgaattatcacaaccacataattaaatgtgtattcatccccaagtaatgacagaaaagatgaagaaaacctaaacaaaccaaaaaacctccagaaattttaacaatgtgtataatgctaataatatttctaactgtgataatagcagtaatagaaggtagtagtactcatttaagtggcttctgttatggctgtagacaagttatttacacatttagcaaagttatgaaattctgtcatctataatcttttcatgtatgaatgattcctttcttataaaactcccatttattctgtagggttgctgaaacacagcaaagtgtaaaagggaaaacaacgactccctctacgttttattttaaaatagaaaattctgatgggaatctgcaatataagccaagatatgtagtaagatctcacatactttctcagatttggcttttttgttgttgttaccttaagtatcacataccctgatagcgtaaagaatcagtatcttttatcctatctatggaaaatataatgattgttgataattttatgagccattgtactaattttaatcgacacatccgctcctctatagcacacttccttgagataaaactggctaatagtatcaactgacctgttttctgttttttcattgaactttaaaatgtaattctttttctttttctggtgctcaaagagatacatttgtttgagtccttgtgtattttatgtatcacattaagaaaattataaagaacttaaaagcttaaggcaaactttaaaaagtgtcttgtcaggttagatttctctttcctttcaactaaaaaacaaaaaaaaaaaaggaaaaaggaaataagggaaggaggaaggggtgggggccatcaggtggtaaaagcctgtttaatgtaacatcagttgtggagaaaatattaggttcaattacataaggattgtgtgagagggagcaccttgagaagcataatttaattagaatgaatttatgagcgagaggtcctgagctattagacaaagcgaaggcagtggtgtgctctcctttcacgagagcattttaatgagtttccatacaaagtatttcaggtaaaagatttgtagcaagtgtgaatagaaatgtagctccaaataaaaactgtcaaatagctctagtagcaatttctgggctaagagtatttaataaagtatgctgacattgttatttcttgatgattttattgaacaactatcgtgtaagaaaatcttaaaaaaaaaacactcagattccaatgtgttctttaatttgccattaaaaattgaactgcagggctggccttgcttgacttccaatttgggcaggtgttagattgtgacttacataacattgcaaactcatccattgccctgatattccagaaggataggtgccaatggtaacttaagattgagatttcacctttatggcttgcttcctatttctggtaagagggaattaaagcgttatctccctatagtgtaattatggtcataaacttgattagagttctttaaataaaatccaactaggaaaaaggcaggaaaacactgtggtcaattttggggaaggaggatggaatacaggcatgaccttcaccttggtcaaaatatgttccctaagactctgggaagtcttgtatatataagattcatatggcagggtttttaaaaagttgacaggagagtacatccttgtttaaggatttatttgtgtatgatcctcacaaggtacatttttgagatttattgcaaataattctgttaatcctttcctagatattctgacatgccaggtggttaaagaaggatgatacataccaggtctatagaaatatcataaattattacacagtaatataagtatttttgtcatccatgactaacttttaaaatggcaaaattataaatatctgtaaagtctatgcgcagttgttactgattattgtggcaataatacataaagaacatgttttttgttttattttccacccttatgttttatttataaaacaaaaatttatatttgcacaggaggagaattagcaggatgtaaaataaaaatgaaagaccccaatggggagaatattttaaatgtcttgcagggagtggaagaaagctttgcttaaaaatgtcaccatatgctaactatatacagcacttcaagtttatttattgttaaagcctcatgtaaatcacgtcattctgaaaatcatggaaactgcacatttgtgcattaaactatgtaaacaacaaaaactggtcatccgtccaattgttgcttcacttattttgaattatagtgcaattttgtggagggtgaaatggggattacacaatatagcgatttcctgttaacacctacatttttgctgatcaagcaaggtctgttggtgcgagagcttaacctttattttatttccaaatgtgttttttattccgagtcccgttggtgtctatggtttcacttttctccatgagccacatgttaaagcctgccctgactaaatgaaggagtgtaagcagtgggatagacattgcaggcaggcgaaactgggataagccccagaatcttttgaacctatcagtaatattactaacagggagaaagtataaaagtgagcgcttcaagtgctctagtgtacatgtcaaaattaaagcacgagttccacgggatggctcaccaccctcccttatttataaaacagaagtatcttttgagcccgctgtgccctcctcccccttttctatgcctgtttttctgcctgggttgcctggtttttgctctgcttgttgaaaccctgctcatccttcaggctgcctcaaaacttttgtggaagaaggtagggaacacatatctcttcttttgtccagccttccttgattagccttcttcctctcccttctacccattgtacatggtttctgttgccatgtagtggttaaatctggtttacgttgtagttgtttgtgtgtaaggaggtctcctacaccgggccatgttttcttaaacactgggatggtgttttcttagtgcttgtgatgttctttgtaacagtgggtgccctataacttttgtttggactgaattaaagaaaaaaaagaaatcgactttagtaggagccggcctttgagtgataaagatacattgagggaactctgtacatccccaagatcgtggccagttgccaggctccatttggattatgggagagcttaaccccatatttcagggcagatatttaggtgtgtgtatgagctgtagttggtgaatactcatttttgaccaaagaagatactggtttgttttccaggtgttgctgtgacttccgtttctgtaaattccgtgggatgtattttgccaccaactgcctagcagtttatgaaatggtgaactggacgggggcctttctgcatccacattgctctcattaaagtgacccctgctttcctctggccctcttgaagtgtatctagtttagaacttcttattagtctgtggtcttaagatctttgtcatcttaggcataggctcaaaggaattaaacttgggttttgattagtgaacttgagccagttagctggtggactggatgttattcaggcataaacttactcctatgtagtttctagaaggttggcctgggccacagaactttctatagaatatctcatccatgcatctatttggatttagagcatggatgtaaatgaccctaaaggtagtacctaatgtgagatgcagcaggagggacctttatatttttttattttttattttattttttttaagaaacagccttttctatgcaatcctggatggttacgtaagttccattttatttgtatctatattccttataaagacaaagcagcaaaaatgcactaaaattagatttaatttccagctgtgggtatttgtattatgtctgccttagtccaccttctgccccccccacccttgggttgatgtggttactgaagatagtgaggctatctggagattggacattgaccttcactatagaacaaactcaactgttcttatctaccagggatggtgagttgaagacacctgtagtctatgattagtttattgtgtgagcatttttctgacatatgctgagtgatattgaaaacatttaggtagagcttttttctctaaaaacctgctcattcattcactccatgactttttacttggcacccaccattctaggcactgggattgtattctgttggcccaaacatacttcactttgttgagaaggtttagcataggactaggaacatgctagtatacactgatggatttaaagcccattgccaattataaattcattttcactatcaattaggtacttaatggctatcctataaggtaatactattattatctatctccattttacaaatgaggaaactgaagcacaaagaagtggatcagtttatcgaaggccatactgctaggatattttatagaaatgcgttttgaaccgaggttgtcttaattcccaagtctgtactcttaatattatactaagttgcctgagaattttagcaagacttagcctaaatgatgtagagcatctcaatttctgtgcaggtccatttaacagattttcttgattcaagaggtgtttcatcataactcaattgtcttagcagttgtataaaaagctagctctcagagatggggctttctcataggcatagcagtaattatgtcaacatagagaaacttctagaatcgagcaaatctggtgctcctggctgtggcctagcactcggtccagtgtcttcatattaacccatttatgctggaggttgcaattttttgaatttttgcaatcagaccttggcgatgatcttgagcagtaggatataaataacttccacatccttagtgttccaataatggaacactaggcataaatatgttaaaaagtgaaagtaggaagtcagaaagttgtgagactgggcagagttcaaacacttggttatccaacgagacaggaccagagaggtttgttgaattgagcggacgagaacttcaacaggctcacgtttagtccagtcagtgtttcagcactgacacaggttaccatgttttaccttgattcacagtttcacagtagtcagcaaatgccctacactgaggttttactctttttattttgcagccctttttttttttttttttttttttttttttgagacagggtcttgcttgctgtgtcacccatgctggagtgcagtgatgcaatcatggctcactacaccctgacctccctggctcaactgatcctccctcctcagcctcccgagtagctgggaccacaggtgtgcatcaattaacttttttatgcccaactaatgtttttaaaattattttttgtctccctttattgctcaggcttattttgcagacatttttaagacaaaatttttgttatgtaagactttttgttataaaaattgttatataagactttataagacataaaattttgtaatatgaggcttttcctggttgaaaagtgtttcatttttcaatgttttgtatttgtatgaaatcagtctttttgccagcacactgaatcttgtcagattggatgcagagtttctttctgcaacacttttactgtttggtaacaaccttttcttaggaggagaagctacagatactaccttggctgctaacaagttttcagattagaccaatttcacagtgttgactagggaagaaaactgattgaacttccatgggctttagactgaaaccaatgactagcattttatctcttttggatgtgagcatgattagaagtcagtctgaagattttctttcaccagcattgataattcttgtcagtgcgacctcagacacatattgccttcttttctgtgcatcctctgaccagatagaatttcttctattttggatgacatgctgcattttaaagatgcaaggtgtaatctagataaatataaattcattggatgctacctttggaaaagagctgaggattatcttagagctgttcttttcctctttttctttcagaattgttattttctgctcaagattgccctcccaagcctacctcatggcagcacacacacacatacagtcacattcaaacacaccattgtactgttacttgcaaaattttgcatatttgggaccaacatacctgttattctgaagtgctgtcgtatgaaagaataagtaaaggtactgtttatatctttcgatgtatgtctagcactaatgggagttaggggacagatagatgtcaactccatgcaaagaaagtcattatgacaatgaagaaggccaacagtggacttgtggaggagctggggaccctacatctgggagggaatggttctgctgaggtggttcagagattttgtagctgtgatgggttagaaaattagatgagaagattgtcaaaattttgtacaatgtacagaattttgaaacaaaaatttaatgaatggtttggggaataaatggcattttacgttgactgttttatttctctcaaatttagaccctcactgggaaattatttttgagtcataaacaatagacccatttcacatctattcatattttctctctctccatgatttttagatttaaaacaagaccacaagccaactttaaacagttcatctttcttcctttttttattgttttttaacttcatggttttatctcagataatttgctaattctagctacgggtgccttcctcccagctcccccagtgtggtagctgtcattcttaacaaactgggatactcacgagacatctagagttcagttgatgatagtccagagtgtgtgagcagtgcagggaaatctgtagctgtgagcactcatctttgaccacagaagcgctgttcagatgtggccagatggaattcctatgaatctctcttctgtgaagtgggatttttgtggcaccaacagcaaagcgattcatgagtgaaaagccttctctggtgctgccatttccatcactgtttctgcctccttttgcttttgttaggcgtaggccctttatttattcagacaaaagtttttaaaagattagagcatacttccatattaataacatcccatgagttaccattttgagggaaatgtgcacatttgtgtaggggttttgctgaggaaaaggaatgaggagtgaaaggagtctcacccagttggatagtggtatgccttggaaatgcactgaacctttttttttttttttttttttttgatgcagctcttcacagatggataaggtaaggcactgtctgcaatgcgtgaagcactttttaaaaagtgagaactcccagtagacctgtggtgttgcaggagcaggtcaagtgctttctttctttaatatttagctaagagagatcacttaggtgaaccgttccctataactagatcatcctttgctttttcctgttcacattatgattgaactcttgtttttgtacaccagtaaaatcttgcatctgaaaatcttattgcaagcaagtctgcccagttttatcattttttctgccatattccttctgagagcagctagtttggaaaagtatggtccatgccaggcagagtgagctcagaagaggaagggaaatatgtagtgttttaagagcatgaagaggaaaagactactctggtagcttttctatctgtatgtttgttttggcttttagtcttgaaaagactcaaattctctttcccatcctttatttctaaattcaaagggaagcagtttgacatattagaagccctgtctttggagtcaggaagacctgagtttgaaactgtgtgttgtgaccttagacaaactacttaatctttctgagatccagtttgctgtctgtacaataggaataatagaagtctatcataggattgttataagggttaaataagacattgcttatgaaccttatacgtagtggcttgctattattcttgtattaacaaggttgtcctggcatttcttcctactgttaattttcacaaaatatgatatgtcttaagctttattattgaaaataataaagctttaaacttttaataaacatgtctggagtctaagatggaagatgttaaaaagggctcagacgtgattggtttcttgatgattaagtagtgggcagtcaaagatacttgttttatgacacatttaggagaaagtactgaatgaagctcttaacagtaacagcccctttaattaggggaccagagtagaggagtcattcccagcgctgcctgggaggaggatgaatttcctgctgtactggagtagccctgggcaaaggacccaaaagaactgctgtattaaggaaacctggaaactaaaaaacacaagagttttgttttttttttcccctgtcagatattggtcttttgtattccagtggtattaaatggaaatgggttttttcagaggaaaagtaatacttgagagaactccattatctatcagatttatatattttgccttagagaaatgcaacctgttcattgtgtaaaaagccgtcgtgtgtatacagatttgctcttctggaagccatcaatagccagctagggttaaacaggtttcccttcccctaaatggttttgttattatttatttattttgtgttcttttaaaatttatttttccatataatctctgtgagggcagggatcatacagctctcaaggtacacatcacagtatgcagataggcccaaaataaacaaacatctttatttttaaagttttttaattataaaaagtaatacgaggccaggcacagtggctcatacctgatacctgtaatcccagcactttgggaggctgaggcgggtggatcacctgaggtcaggagtttgagaccaatctggccaacatggtgataccccatctctatgaaaaatacaacaacaacaacaacaacaacaacaacaacaaattagccaggaatggtggtgtgtgcctgtagttccagctactcggaagggtgaggcaggagaatcacttgaacccaggagatggaagttacagtaagcagagattgcggccactgcactccagcctgggcaacagagcaagactctgtctcaaaaaaaaaattaaaaagtaatatgggattattatagtttggaaaatacagaaaaatggaagagaagtcaggtacagtttcactgtccaaaaataattaacattaacatcttggtatacttccttccagcctttttctgttagtacagagctttatgctagctatttatgattatgaatacagatatatcctaaaagatcttctcatgctgagcccaggtgttgtaggatagaaactgatggtagccaggcaaagtgtatagacataaaaactgggatgacagaatcacggggaagggtataatacctttgggttccttagctcagggctgtctcatttctgcagcaggcaatgtggttttcctcaagtggaataagattgcaaaaggaaggttggtaagctcaaaagaaatcttcacattgcccctgtgataggtagcaaaggtgatgaaacaacccaattttgctgtgttatggtattcctgttttcagaaaaattaaaaaaacacaaaaaccatttctttgaataaattcaggctttaatgtacttttttcccccagaacatttctcctaagggcttaaattattatcacatatggagaaggagacttaaatatgagaggatgtaagatccttaagcatgtacaaattttcgtggcatctatcacagtcctgaatcctgaaagactattttctgttgagttagatctttccttataaatgctttctgggatggcccatgcatctctgacagttctcatgctgagtcataccttgttctgttaaatttatccattattggacaaagactggaagaatggatatgacattgggaagtgtgcaagacttccacagatcacttgtagagagggatgatttcattgtaatcctacctcactggacacctcaaacctgccagtctcatctgtaaagtgagcatttttatcccctttccttggctctcttggctccatctacaggcaacactcaggtggacttctttactgaagagaagagcgtaatattcttctagtttgcctagctctttggcatttagaaaactagagaaatgcataaatttagcaaaggatcagggccaatgtgatggctgaactggcatcatttcacatttttcatgctctgtatttatagcaataaatttcaagtaagaaaatagattgcaaggagtatgctgtattaggaaggaagtttgtacactttcgtggcttatgggtatcttagtataaccttttctggttgagtgaactgtgtcatttcaaaagcctgaagacattgtgatgactgctgcctccataatggctacattctaggggctttgccctgaatcgcatatattaactcaaaaaacaaacagtacccagtttttattgggaaaattacagtaccagaagttatgtttctcagtcattgagaccttatgaagccttaataatatttagaagattctggttccttgtcttccttttttgagtcagcagttggtcacagttcagaaatgaattacaaattacaatttattagtaatgataatatttaagtagtaatgatgatgataaatagtaacagcttattttttaaaaagataccaagctaaatgctttcatggattatctcatttaattgtctcaacaaccttttaagtcttatatttttatcattgccgttttatagatgaagaaagtcaattttcagagaacttaaataacttctcatagatgtctagagcaaataagagacaccaggaaatattacacccaattaaacatgttttctcccacatattccgtcaattagagacttgtagagaagggtgctatttttcttttcatttttatttttttcgagacaaagtctggctctgtcacccaggctggagttcagtggtgcagtcttggctcactgcaacctctgcctcatgggctcgagccatccttgcacctcagcccccaagtagctgggactacaggcatgcaccaccacacctggataatttttgtattttttgtagacactgggttttgccatgttgcccaggctggtctcgaacttgtgaactcaaaccatctgcccgcctggcctcccaaagtgctgggattggttgctatttttcaaatgtgagaaaactcctttagaagttttagtcttcatgagtcttatgcgcttagggtgtggatttaaattagcaaattgggttgttggatttgtagttgcagcagaaaggggttgtttgtggatttttaagtaggggtgatagcataggggcctgcttttaaaagagggataagcaagcaaggaactttcagtgcttaagggcacaggtggggcagaacatcaaagacagattccatctgtgctaacatttcacctttactccactgaaaattttctaagatgtcacctttgagacacactaaagcttatttttctagacaattaacaaataaattacatttactccaaggacagtgtaatattaatctataaggatattttagattttagaaagcatgagttttgaattctagtttattatgcagtatggtctgtgagccatgaattgtcttcatctttatgtccagcagataatgtggtaaggacttcttaaagctttttgaataattgaattaatgaataaaatttataaagttttctatcatctactaaacatctgcttgtgaattttaaagaagctcattttctataacattaaaaagaggctgtaaaacatcgtttttactaacaatttcattttatacattgcagttgtccttattgataaaagagaactttgtggtttgatgcataaaagaaaatttactattcagtatagttgggactgtatcttcaggcacagacactgcattcagacctgcagacccccaccctgctcagtgtctgggttgcagcccagactgaggttgagccagaggaagaaggaggccgtgtggttaaaccacttgtggataatcgaaagtagaccatacttattttcaatttggcagctgcattagttttttactaaagtgtgcagctttgcctggttctgctaatgttgccttcacactgtggcctggtcaccattagtggtctggcagagatatctgaggaggctcaccattgctcctcttgactgttccactgcccatcccagtattttccctgacttttcctatgttctgtggtatcaggcagttggatcaattgcagtgactgcatcgaaagaaaaagacaaaaatcgggaaagtataaccccgagggcaacaataatgaaattttaaatttaaagtgacccaagtttgatgtacaggatatgaaaatgctgtggttcctccagtggtttcatatactttgattcagacccttagaagttcctggtgggcagttgacaattgagtatcagtcttgatgctccagatttgaataccatttcagttggaggcatggtgcgcctgatatagatgacgtgtgaatgtttcaatgtcaacaggagatgcgggttgtgaagatatgtgttcacatgaaacagactgcaagtctaagtctccaaggatgagctgatatatgtaaccctgttcatgatgggcctgtgtttttttcattttctgttttcctctctggcagatgatagatcatttaaatctgtactggcacatggacgtggtttcccaccccaactgaacttgagttagaagaacctcagctctgtagtgatcttattttactgttttcccaggataaaatgcccttggtaccacatactgtatgcagagtatttatgattgcttgagtacagttccttggaaaggacacaaggggtttcataaagcggtactaaaaatctgcttttctccctagcatttaccaacaaccttgcgatccgatggcttgaaataatggtcagagtgcatgttacccaacttctcctggctgctcctactctgtcacactgcacacagatcatgcccgccaccaccctacactccccgacctcacccaccagtcagacagtttaagtcctgctgacgcaccaggcgtgtgttggctcgtggttgtacttttcatgagtagcagggaagatacactccaggaaggtgggatacaaattattgaactgtgtgacttaaaagctccagtgagtttcgtcggaagtataggagtttgaaagtgctccccagtcaaacccagaactacatagggtcagccgtggttgagctaatttctgcttacacatgtgtggagggtgtcattttctgactacgcctaggcctgagtggacagccgattaaaagatgtaaattcgtggattgtatcaaggagagcgggttccatctttgtggtcaggagggggcccactcttttgttccgcaaagggtttatctggatgttccttgctggaagttgcttttccagtttggatcaaaccacttaagtggagctccagcctcagtccttgcaataaaaaaaaaaaagtcctggaaagccagaattttgctaatatcttacatagaatctcaatgatgggaattgggagtagaaggcagagagtggtgcttggctgatggaagttaaaagttgggttaataataaactacatttatatatcagttaacagcttgctaagtgcccacatattatttgagcttcatacttgcttgctgagaaagaatggctattattatcattatcatcattaccactttccattttatagataacaaaactgaggctctgagaatttaaagagattttccccaaatcattaaacggtgacttctgaatctggatatatgacaagacctctgtccccagtccccttgctttcacctctataatatatagtagctaagctcagctttctgagaacttccctgtcttatgtcatatttgacattataggagaattgaagatgttttgtaagtacatactttgtttactacctcagtagccagtataacaaatggcactgaagttttatgctttgcttgctaaaaccagcaccatttgtgaaacaggtcttggctccgagttacccttaaatgtaactcctttattataaaatcatttgcaaagagctgcagagatcaaggaatacactcttcccacttccctaatgccaggtagtactatgacaggacttcatagtaccacttcttcaacaaaataagtgtctgcagtgaaatatttgttaaaatgcacatttctcagtgaatatatttcttttaaaactgaaaaaaatagtacctaacggaaattttatcattgctttaaaatgtattttaatgaagatattaaaaaatacctttgatggattcttcaatattgtcgaactgctcaaaatgattatactgttatatgaagtctaaaatctttcatgcaacttacaagaatatttttgttgtatgcaacacagttggaaaattctagtgggaccatgtccatgcaattactgattatgtaatgctgtaaatttttgataagcatgttccaagttttcctgttctaaaaacaaaaacattaaaatcacccactgttgaagacaaaagatcattactttattaggagatattattagatatgtttagaactagttaaaaaaaaaaagtaaaagactggttaaaaaattaaattaactccaccaataaaaattcagttccttctgtagctgattaatgtaaggttctttccactgatgaccactgaatagaaaaaactaaagtaaatttcatcatcattgtagaagtgtaacttattcaagtaaatgagataagccaattttatatctatcaagctataattaaataaggatgatactatttgacttataaatgacctctgttttatatttcctgtggaaatcagctaactacaaaggaattgtttattaacttacttcactaacatgatgaacagaagtatttcaggactcatttgccccttttttatgtgactcagcgtcagattctgccctttgctcttctgaggtcagtctgacccagtcaggtaaaatgaacagcacatgaaagtttagcgcatgcggtcagcattcacgtaccttgctttggttaaataaattcttgaaatgcttgatggcttatttgccatgaacttgataattccccaaattgctgatgttaccaggtgcaaggacaaatattgatggctatgaaccttgcatggtgctgatgcactgtgatagtcatatcttgttgtaaaccatgttgtagtgacatagttccagttcatttacccattccctgtatcagagagtttgggccattgttgaacatcgctgagttcagttcatggtgctgggtagttcacatttctggaagggctgtaaggtttgcataatcgtccagtgctatcatcatatcatctttgcctggaagatgcatctgcatagcttcagtagtttttaatgtcttgggatgcccaacccagtactgtgggtttcaatttttatctgtcatcgccacaaacccctaaattaaaaaaaaaacatgaagaatattcaggtgactataaacatttcaaagaaggcctctacttcttgctctgggtaaaaggtagatgcagtctcatggtggaacatgagagttatctcagttggctcttgaaatgagaatgtttcactgtttcagctgaactgaatagtcactttagtttttaaaaacctgctcaattcaacaaaacatgattgattgctcaggtaaattaattgcctctgagacacatgtttgaaatagatatctatactctctctgatactagtgtgtagcaataacttttactgtcctattttgtttaactgtctgtgtatgtatgctctaaaaaggggattgaggctggaagcagtggcttacgcctgtaatcccagcactttgggaggccgaggcaggcagatcacttaaagtcaggagttcgagaccagtctgaccaaaatggtggaaccccgtctatactaaaactacaaaaattggctgggcgtggtggtgggtgcctgtaatcccagctacccgggaggctgaggcaggagaatcgcttgaacctgggaggcaaaggttacagtgaaccaagatcacgccattgcactccagcctgggtgacagaatgagacttcatctctaaattaattaattaattaattaataaaaaggacattgattaaacttttttttttcttttttcttttttttttttgagatggagtttcactctgtcacccaggctagagtgcagtggcgcagtcttggctcactgcaacctccgcctcctgggttcaagcgattcttctgcctcagccttctgagtagctgggactgccggcacatgccaccacaccttgctaatttttttttttttgttttgtatttttagtagagacggggtttcaccacattggtcaggctggtcttgaactcctgatctcgtgatccacccaccttggcctcccaaagtgctgggattacaggtgtgagccaccctgcctggccgattaaacttttcaatagctatatctactgtatggactctattaatgtacataattatgcccagaagagaactatatgtcattattaaatttatggttagaatagttgatctatacttttttctccttagcattcctttagctgtgcttccagagctgctcagaaacatgagttttgcttaataatccatagcagagctgaagtcaagaggggaaggacccacaggacttcagctggatctggttgggaaaagctcaagattgggaaatggaactttggtaggcacatgtcagtatgaaacatttgcctcacagccccatacatgattaacctttactttgcaggggaaaggctcacagtcttactgcagaatgagaataaacctcatttcagtggtttataaactcttaaatgtaacagaatataggcctaaaattagacattgtattcagtctgagctctgccacttaagaattctgggactttgggcaggctgcttattatccactaacctcaatttcttcagctcctaaaagggcagttgtcatacctatattatggcactgttttgaagaagaaatgaggtaatgcctaaaagtgtttaacatagtcactggcacagagaagatacttaataaatgttgatttccttcttgttcagcaaaaccttaaggcagaaagctcctaaggcatgattatatatttcattctttcagtagcatttgccaaacatttttaccatattgttgctaagtaggtaaaacagaaagacacatatctaaatatgcagagacatattttgtaatggaggtaccactctgtttttgtaaggcgttgctgattctcacttcgcttctgcatctctgaatatgttacaattgtaagagatgtttgaagctttggggatcttctaatggaaatgggggttcttcaccgaatgttcatgtaccgacttcaagaggtcaaagaatcacgaattgatatacaaagtggtgtatgttggagtatagtcgtcgcttggtatctgcaggggattcgttcccagacattcccacagatgataaaatccacggatgctcaagttcctcacagtcagtccttcatgccagtgggttctgtatccatggattcaatcaaccacgaattgaaaataccgtcatcacgtaaaacttgtaacatacattctaggaaaaagaagaaaataaaatcaccttgggaaaataatccttaaaattttactatgtagggatttattcttccaaacatatatatgtatttttgaaatcctttaaaaaataatgctgtatcacaagcacctttccctattatgtattcttctacagaatcatttcagtgggcgtatagtatttcatgttattgatggatcatttgtgaaaccaattctgtgatggtcactgagtttgtttgcaagtttttattattataattaatgtggcaattaagatctatattgctcaaacatgactgtgtacttatagatcatctttgtaaaaaagcagcattaacttgtgtttttaaaacatttttaaacaaaactaagtgataagaaattgatcaactcagccaggcgtggtggctcacgcctataatcccaacactttgggaggccgaggcgggcatatcacctgaggtcaggagttcaagaccagtctggccaatatggagaaaccccgtctctactaaaaatacaaaaagtagctgggtgtagtggcgggcacctataatcccagttactcgagaggctgaggcaggagaatcacttgaacccacagggcagaggttgcagtaagctgagatcaggtcactgatctccagcctaggtgaaaaagcgaaactcagtctcaaaaaaaaaaaaacctctaccctttattattgcttgcatactttgtaaaagaattttttccaaccactagcctcaattatttctaaactatttttaaacatttattagatatatggatttggcatatataaggagtctagttaggcttaaaactatctaaggaactaccaactatctaacatttaaataatagaacaaagaagccgggtgcggtggctcacacctgtaatcccaacactttaggaggctgaggcaggcggatcacgaggtcaggatatcgagaccctcctggctaacacggtgaaactccgtctctactaaaaatacaaaaaattagccgggcgtggtggcgggcgcctgtaatctcagctatttgggaggctgaggcaggagaatggcgtgaacgcgggaggcggagcttgcagtgagccgagatcgcgccattgccctccatcctgggtgacagagcgagactccgtctcaaaaaaaaaaaaagaaaaaaggcgggcggatcacgaggtcaaaagatcaagaccatcctggctaacatggtgaaaccctgtctctactaagcatagaaaaattagtggggcgcagtggcccacgccttagtcccagctactcaggaggctgaggcaggagaatcacttggacccgggaggcagaggttgcagtgagctgaaatcgcgccactgcactccagcctggagacagaacgagactccgtctcaaaataaataaataaataaataaataaataacgcataatagcttctatttgggggtggcaggtaaactatggcatgtcaggtcccatcggcattttccgccaatgatagggaggcatgttttatgcccctgtctttctgttgatgagaaaggagcaagtgaagaactccttgggtcttaaggaacaaggactagaaaccccacaatattagtgtttctgttttttgtaatgatctgtcacctcctgtttgttttcaaaacccatgagattttaactctgcatgtgtgtgtacatgtgtgtttcttccctgttcatattgcctccctatccatcagagaatatcttaaatgccactgggatacttgatgccatcccctccatttgtgggtttgtgggctagtccagcaacaggctttggagaagttactcgctactttattataacatacttaaactcaatagcaattcaggccttactgggtatttacctaatttattgtggcaatgcggtatttagaccactgattaagtgaagtttgtcagtatagttaaaagaaattagagacactatcattgctaaatcactttacaattcaaagaagaattgtaaacatatgaatccatttaattataatagtgccaattataagagaaattgtaacgctgggaacagtggcttttatgtaatcataataatggcatgtatttatcttggtttggcaagttaggcctttctttaatacttggctttgcctaaatagaatgtggtttgctgaaacccacaataacccccacaccctccaatttgttattgcagaaaatactgaacaataatcatgcggtatgaatgattaatgtatgcatgggttagtaagtatatttgaggtttaaaaagtgtttttatttacattcttctgttggctgaaggtataaaacaaataaatataaatccacatgttaaatattctcatccctttccatacagatacttgcagtgtgaatacaatcatagctttaattcattgtttctgtgcttttttggtttactcaacacgtgtcttttaaatatatttcaactgtagtatttgatagtaatccattttttaatttactaagtactttgaatatagcttccccaaaacatagaaataatcaatttaataatatctgaagattggcaaacttcatttataatgttgtgttcaaataatactatcagaataacagttgtttgaagagtgtatgtataaaaattacattctctatttaataagattactattattattgaggaagaggtgctatctagtggtataaacaaaattattatggaattgaaacatttctacactttggtgtcagggttttcatttatttctgtttcctgcttccagaaagataatttgcagcagtttcacactgtgtattagtagatgtggaaggaaatcctactttgctgagaaaagaaggaaggaatttaagtttaaaagggatctgacaaaaacttatttaaaaatttttattttaagaataaatagaccttccatagacacttagcatttattgtaaaagctgtattttatagagaacagtagaaatccaaatcgttgatagttttgcaagacatagccaaaaagtgaagataaatggtggattttaaaaattggcatcctgaaagagttaatatttttattagttgaaatttgatataaaattgtgggcaacccatgacatggtttggagtacttgattattcttttctcaataaataagagtggcgtacagttaatttcagcactgtaattgagcaatgcattctgggaagt
